United States Patent 7,608,413 (KIDNEY DISEASE TARGETS AND USES THEREOF) - sequence listing, part 2

SEQ ID NO: 3205 - DNA, 6547 bp, Homo sapiens
taactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggtttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagccaacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaaccaaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatctaccagtgccctttctgcattttcttaattattgtcatagtctaaatttcagagccatggaattttttgtgt

SEQ ID NO: 3206 - DNA, 2579 bp, Homo sapiens
cctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcatttaaaat

SEQ ID NO: 3207 - DNA, 9065 bp, Homo sapiens
cggcggcctagaagatggcggacggcgacagcggcagcgagcgcggcggcggcggtgggccgtgcgggttccagcccgcgtcccgcggcggcggcgagcaagagacgcaggagctggcctcgaagcggctggacatccagaacaagcgcttctacttagatgtgaagcagaacgccaagggccgcttcctcaagatcgccgaggtgggcgcgggcggttccaagagccgcctcacgctgtccatggcggtggccgccgagttccgcgactcgctgggcgacttcatagaacactacgcgcagctgggccctagcagccccgagcagctggcggcgggcgccgaggagggcggcgggccgcggcgcgcgctcaagagcgaattcttggtgcgtgagaaccgcaagtactacctggacctcaaggagaaccagcgcggccgcttcctgcgcatccgccaaacggtcaaccgcggcggtggcggcttcggcgcgggccccgggccgggcggcttgcagagcggccagaccatcgcgctgcctgcgcagggcctcatcgagttccgcgacgcgctggcgaagctcatagacgactacggaggcgaggacgacgagctggcaggcggcccgggaggcggcgccgggggcccagggggcggcctgtatggagagctcccggagggcacctccatcaccgtggactccaagcgcttcttcttcgatgtgggctgcaacaaatacggggtgtttctgcgagtgagcgaggtgaagccgtcctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttctttcctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatttgagattccaaatgcggccgggcgtggtggctcacgcctgtaatcccagcactctgggaggctgaggtgggcgggtcagttcaggtcagcctggacaacatggtgaaaccccgtctctactaaaaatactaaaattagccgggcatggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacaatcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttttgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagt

SEQ ID NO: 3208 - DNA, 8366 bp, Homo sapiens
ccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacggaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccaccaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacaggacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataattttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtccaagacaatatttgattcctagttctgtttggggcaaattttcatttatctaaataaaatgcaatctaattaaa

SEQ ID NO: 3209 - DNA, 8065 bp, Homo sapiens
tgcttttcgctgcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacagttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccaccaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacaggacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataattttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtccaagacaatatttgattcctagttctgtttggggcaaattttcatttatctaaataaaatgcaatctaattaaa

SEQ ID NO: 3210 - DNA, 6608 bp, Homo sapiens
ccttcttttaaggagtttgccgcgagcgcgtctccttcattcgcaggctgggcgcgttcgcagtcggctggcggcgaaggaaggcgctctcgggacctcacgggcgcgcgtcttttggctcttgcccctgtccctgcggcttggggaaagcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacggaggttggacagagagactctgaagatgtgagcgaaagagactccgataaagagatggctactaagtcagcggttgttcacgacatcacagatgatgggcaggaggagaaccgaaatatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccaccaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttggaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagaaggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaggcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggttccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacaaaaaacagagcctcctagatgtaacattcctgatcaaggtacaattctttaaaattcactaatgattgaggtccatatttagtggtactctgaaattggtcactttcctattacacggagtgtgccaaaactaaaaagcattttgaaacatacagaatgttctattgtcattgggaaattttgctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcctttaagaacaatgttgcaacacattcatttggataagttgtgatttgacgactgatttaaataaaatatttgcttcacttaaaaaaaaaaaa

SEQ ID NO: 3211 - DNA, 2867 bp, Homo sapiens
gttttcttctttgagaaactatcccagatatcatcatagagtcttctgctcttcctcaactaccaaagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagagaaacgatgcagaaatccagaattaatcaatgggatagtggaagttaaaaaagatcttctccttggttcaaccatataattcagctgctcagagggatttttcttaattggctcaaccaccagtcattgtcagatccaaggtaaaggagttgattggagtgatcctctcccagaacgtgtaattgccaagtgcgagccccctccagacatcaggaatgggaagcacagcggtggagatcaagaattctacacatatgcctcctctgtcacctacagctgcaacccctacttctcactcataggcaacgtctccatctcctgcaccgtggagaatgaaacaataggtgtctggagcccaaaccctcctatctgtgaaaaaattgtctgtcgtcgaccacagattccaaaggcaatctttgtttctggatttggacccctctatacttacaaagactctattatggttaactgtgaggaaggttatatcctcagaggcagcagtttaatctattgtgaaacgaataatgagtggtatccttctgttccctcttgcatatccatgaatggttgcactgtcctaccggacatttcctatgcttcctgggagagaaatgactacaacctaagtgatcacgaaatatttgaaattggaactgagttgaaatatctatgcaaacctggctatagacctgttttagatgagcctctgactgtgacttgtcaggaaaatttgacatggacatcttccaatgagtgtgagagggtatgttgcccaacaccagatctggagaatatcagaatcataaatgaaaggaggtatttcactggtagatgtgtctatgcctatggagactatatttcatatatgtgtgatgaaggctattaccctatttctgttgacggggagagttcctgccacacagatggcacatggaagcctaaaatgccagcatgtgagccagtttgcagttaccctcccagtattgcccatggacactacaaggaagttattttaataactccttatcctgaggctacatatgaatgtgatgaaggatatgttttggctggatttgctacaatctactgcaagtcttttcactggcaacttgcacctcctcaatgtaaagctctgtgtctgaaaccagaaatagtgaatggaaggctgtctgtggataaggatcagtatgttgagtctgaaaatgttaccattgaatgtgattctggctatggtgtggttggtctcaaaagtatcacttgctcagagaagagaacctggtacccagaagtgcccaggtgtgagtgggaggcacctgaaggttgtgagcaagtgctcacaggcagaaaactcatgcagtgtctcccaagcccagaggatgtgaaagtggccctggaggtgtataagctgtctctggagataaaacaacttgaaaaagagagagacaaattgatgaacacccatcagaaattttctgaaaaagaggaaatgaaggacttatttttcccttcaaatcaacatacagaatcttcactcatccaccctactcttccttgagcaccatcactctcataagggtctgggctaggagaactttcttattactgccagagaaaaatgtgtaattattggtaatctagccttttgtagctcaaatgtccagtttcctggacttgaagtgctggttaattaaataattatttaccaaatat

SEQ ID NO: 3212 - DNA, 2136 bp, Homo sapiens
gttttcttctttgagaaactatcccagatatcatcatagagtcttctgctcttcctcaactaccaaagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtat

SEQ ID NO: 3213 - DNA, 2178 bp, Homo sapiens
aaaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtat

SEQ ID NO: 3214 - DNA, 2136 bp, Homo sapiens; identical to SEQ ID NO: 3212

SEQ ID NO: 3215 - DNA, 1766 bp, Homo sapiens
tccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 3216 - DNA, 812 bp, Homo sapiens
  misc_feature (1)...(812): n = A,T,C or G
taattttagacaagcagttgagctaatttgcacgatgcgggttattttgagaaaaattggttaatgagactgattttatgagagtcaagcgggtttgttattaagctattctttagggattttgtgattaaatacttaaatacttaaatacttaaatacttaaatacttaaatacttaaatacttaaatacttaaatacttaaatacttaaatacttaaattaggtttatctgcagttaaggctatagactggtagtttggcgttgggtatatcacaatttatattttaggagatttataatggcggttgtaattaaagtcgttaatggcaaaatacaggaatttgagaatggtagctttaaaagaacttatggtagtaatattgtagctgcagatactgatgggcatattgtngctgctgttactgcaaagggtaaagtggaagaatataaagatggtagctataaaataacctactagaaaatagggtaatagtggcaatagctttgatgtattcagctagtaggggggtgtcgctgtttttctagtggtgttttaatgagcagttgtgatagaaaaagtctttgtttgcaataggagaggtgtcagctatttgattgttttagtaaagcccttggtagggcgtgcgttaaaagacgcttattgtttngcatagaactgattagttggttttaagattattttaatcgtgggggttaggacttattcataatcaagttatgttacaatacataaaatttaactttaataatagctataccatttaaagaagcatatacaaacacagatca

SEQ ID NO: 3217 - DNA, 1666 bp, Homo sapiens
cgagccagcgagagggcgcgagcggcggcgctgcctgcagcctgcagcctgcagcctccggccggccggcgagccagtgcgcgtgcgcggcggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 3218 - DNA, 2501 bp, Homo sapiens
agtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttatagatattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 3219 - DNA, 1482 bp, Homo sapiens
atgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactag

SEQ ID NO: 3220 - DNA, 2796 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 3221 - DNA, 2628 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 3222 - DNA, 2800 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaaggcagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 3223 - DNA, 1546 bp, Homo sapiens
gctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttg

SEQ ID NO: 3224 - DNA, 2478 bp, Homo sapiens
ggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtcagtccaggctggaatccaagaacctggagtagtggtgggttggtagtgatgccagtagtgatggtgatagtggtagtgatggtggtggtggagccactatgtggctttttaaggaagggaaatagagaagccacgtatggtctagaggtcacgtgagggaaggagaggaagtcattctggtgaaggcaactgtgtgtaattctgtgtgaatagtccctcattgttccccatgacccttaggacaaatctaccctctttagtcttacatacaagtctctccatggccaaatccctattggcccttcagctttgacttttattatacttttaccttaacactaagctccagaaaccctatgctattctctgtacactcagtttgctccatgctttggaatctttcctctctctggggttccatctctccttgtgtgccttttaattcctacttcagatttcactttaagtatcatcttccctgggaagttttcccagactctccccactgcctttgctgagctgatcctgtgtgttttgctgctgaattttggtgtatgatcaccctcctttagccatctctctgatggctgtgagctccatgtggtcagtaccattatctggcccatcctgggacccagagaaagcacaaaggagggcgtaacccggtctcaccaaatgcctgttgattgattggacaaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 3225 - DNA, 1635 bp, Homo sapiens
ggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 3226 - DNA, 13711 bp, Homo sapiens
cgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggacgcctggcctctgtgtcctagaagggaccctcctgtggtctttgtcttgatttttcttaataaacggtgctatccccgcca

SEQ ID NO: 3227 - DNA, 14194 bp, Homo sapiens
cgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatc

SEQ ID NO: 3228 - DNA, 13711 bp, Homo sapiens; identical to SEQ ID NO: 3226

SEQ ID NO: 3229 - DNA, 13711 bp, Homo sapiens; identical to SEQ ID NO: 3226

SEQ ID NO: 3230 - DNA, 3030 bp, Homo sapiens
aaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggcaacaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 3231 - DNA, 3030 bp, Homo sapiens; identical to SEQ ID NO: 3230

SEQ ID NO: 3232 - DNA, 3030 bp, Homo sapiens; identical to SEQ ID NO: 3230

SEQ ID NO: 3233 - DNA, 2972 bp, Homo sapiens
ctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttttgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaaaaaaaaaaaaaaaaaaaaaaaaaaaaaaaaaaaaaaa

SEQ ID NO: 3234 - DNA, 3636 bp, Homo sapiens
tgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaa

SEQ ID NO: 3235 - DNA, 2447 bp, Homo sapiens
ccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttaaaaaaaaaaaaaaaaaaa

SEQ ID NO: 3236 - DNA, 2975 bp, Homo sapiens
ggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatggttcctctttggtgtacagacttcttggtacccagtcacctctgtcttcagcaccctcataagtcgtcactaatacacagttttgtacatgtaacattaaaggcataaatgactca

SEQ ID NO: 3237 - DNA, 3592 bp, Homo sapiens
gaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatttcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaaaaaaaaaaaaaaaaaa

SEQ ID NO: 3238 - DNA, 3433 bp, Homo sapiens
gaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatg

SEQ ID NO: 3239 - DNA, 3433 bp, Homo sapiens; identical to SEQ ID NO: 3238

SEQ ID NO: 3240 - DNA, 3433 bp, Homo sapiens; identical to SEQ ID NO: 3238

SEQ ID NO: 3241 - DNA, 4015 bp, Homo sapiens
cgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaaga

SEQ ID NO: 3242 - DNA, 2074 bp, Homo sapiens
cacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtggaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatctttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcat

SEQ ID NO: 3243 - DNA, 4022 bp, Homo sapiens
cgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaaga

SEQ ID NO: 3244 - DNA, 4503 bp, Homo sapiens
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagcggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattga

SEQ ID NO: 3245 - DNA, 3000 bp, Homo sapiens
tccaattcaaaaagaaagtctctgacgttagttagtttaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagcggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttc

SEQ ID NO: 3246 - DNA, 4905 bp, Homo sapiens
cagttgatcactctgaagctttttggctaaagcgtttgggtttagagcttccattactcatccgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgatttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatgggctgtaacagttgctgctagtattagggttccacatcattctaatgtatagtttcaagt

SEQ ID NO: 3247 - DNA, 4905 bp, Homo sapiens; identical to SEQ ID NO: 3246

SEQ ID NO: 3248 - DNA, 2367 bp, Homo sapiens
cagttgatcactctgaagctttttggctaaagcgtttgggtttagagcttccattactcatccgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtaagtggactggaaaccactgtcta

SEQ ID NO: 3249 - DNA, 4905 bp, Homo sapiens; identical to SEQ ID NO: 3246

SEQ ID NO: 3250 - DNA, 5231 bp, Homo sapiens
cacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgatttttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaaacaagtcagtggcttaaatgtgattatggtcctgcaaggtgattcttgctaaaatatctaaacttttgttttgttttaactgaatcattttttaacttaaaaagctggaaaatatcaaatgctgtttttttttttcattgtcaacagtggtgtgtcattttatgtatgttcctaatgcttatggaactcctccaaaataaagttactcaaagag

SEQ ID NO: 3251 - DNA, 2832 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggt

SEQ ID NO: 3252 - DNA, 2833 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggta

SEQ ID NO: 3253 - DNA, 3164 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtct

SEQ ID NO: 3254 - DNA, 3164 bp, Homo sapiens; identical to SEQ ID NO: 3253

SEQ ID NO: 3255 - DNA, 3659 bp, Homo sapiens
cccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtgagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattactctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgt

SEQ ID NO: 3256 - DNA, 2151 bp, Homo sapiens
acagcatgatgtggagaaaagttgtgcagcattaagaagtacatgcaaaaattaagtaaccaagttttgtctacatagcagatatgtttacattggatgtcaaaagtaacacagtatttgatataattacagataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcagaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggaggcaactcttgtcttttagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagcttttctgtccatgtgaatgtgctgtgtggaagagttaaagggcccaactaaatgttccagtgattccaatagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttat

SEQ ID NO: 3257 - DNA, 6846 bp, Homo sapiens
ctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagaataaacagagaggcataaacatatcttagagtccaagtggtagtgtttagcattggatataataaatggatgttttacaaagtgtttccataattctcttcctatacataaatgtcttgttttcaaaagtggatggaacttggctgggtgtggtggctcacgcctgtaatcctagcactttgggaggccaaggcgggaggatcacttgagctcaggagtttgagaccatcctgggcaacatagtgagacctggtctcttgaaaaaaaaaaagtggatggaacttgtagcagagaattttatctacttctcaacctgcttcagaatacccatttgagatgttcccctggaaagatgaacacaatactgcatctgaagccatttcttcccacctaacattcttaaaatgattagagtctaaactttgtcattcattcctaattctggagctctgaggttgaggtgttcagagtttggtgaataattgggtttaagttttaacattttagtaataataaaagcaaacacatacatgttaaggcctgacaataggttgcaatacccatgcattgggactcatacccagcataaatggtgagggactgaacattagtgctttgagcaagaattggttaactacctgagatctctaaaacagtaatttgaattactaatacataaaccacaagtctcttcgaattgttaattgcctaaatttaccctaaaacttagttaacgctgcagtgcctttattaaagcttttttttgggggggggtgtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagc

SEQ ID NO: 3258 - DNA, 4233 bp, Homo sapiens
ttggaagcgcactgcgcggcctccaccgcgctctcggcccgggttcggcgtgggggcggggaggtaagtacggtaatgggcggggccgagcgcgggcgcgctccggctttcctcctgcgcagtgctcccgtcagcgcagggggcggggcgcctatattacgtgcgcggcgccgctcctgcgagaggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagaccagaacggcgacgatcagggtttccaggaaggggaagatgagctcggggccgaagaggaaggcgcgggcgacgagaacgggcacggggagcagcagcctcaaccgccggcgacgcaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatatt

SEQ ID NO: 3259 - DNA, 985 bp, Homo sapiens
tatcctaccacctgctagaaaacggccccacgggacgcggtggctcacgtctgtaatcccagcactttgggaggacaaggtgggaggaacgcttgagctcaggagttcgagatcagcctgggcaacatagtgagaactccgtctctgcaaaaaacaaattttatatacatatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 3260 - DNA, 985 bp, Homo sapiens; identical to SEQ ID NO: 3259

SEQ ID NO: 3261 - DNA, 973 bp, Homo sapiens
tcccggggtcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 3262 - DNA, 994 bp, Homo sapiens
aggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagaagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgt

SEQ ID NO: 3263 - DNA, 2770 bp, Homo sapiens
tgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgt

SEQ ID NO: 3264 - DNA, 2298 bp, Homo sapiens
tgtgctcgctgctcagcgcgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacttggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctagacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtccccccaaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 3265 - DNA, 2770 bp, Homo sapiens; identical to SEQ ID NO: 3263

SEQ ID NO: 3266 - DNA, 2770 bp, Homo sapiens; identical to SEQ ID NO: 3263

SEQ ID NO: 3267 - DNA, 923 bp, Homo sapiens
gaagaaggagaagaaggagaaggagaagggaaaaaagaatcctcatcattaatgcaagtggaaggaaactcttcaccaaagaattgatcacatcatgaaaggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgaggtgagttgtcacagggagttcaaaaaatgaca

SEQ ID NO: 3268 - DNA, 2247 bp, Homo sapiens
acaggtgacgctcctcccgcctgcctagcagagctccaggcgcacatccgcagtcagccacctcgcgcgcgcctccaggagcaaggatggagaggctgactctgaccaggacaattgggggccctctccttacagctacactcctaggaaagaccaccatcaatgattaccaggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaaaaaaaaaaaaaaaa

SEQ ID NO: 3269 - DNA, 2263 bp, Homo sapiens
gggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaattttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactccaaatatttggcttatgatattctcttgggaaatgtggaaatgaatgataatccttgtcttttcccatcatatgtaaaaccctcccctcctctctatctttcccctcctaaaagatgagctgggctgggcgcggtggctcaagcctgcaatcccagtactttgggagg

SEQ ID NO: 3270 - DNA, 2263 bp, Homo sapiens; identical to SEQ ID NO: 3269

SEQ ID NO: 3271 - DNA, 2263 bp, Homo sapiens; identical to SEQ ID NO: 3269

SEQ ID NO: 3272 - DNA, 6445 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccagttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3273 - DNA, 6442 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3274 - DNA, 6427 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3275 - DNA, 6436 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3276 - DNA, 6427 bp, Homo sapiens; identical to SEQ ID NO: 3274

SEQ ID NO: 3277 - DNA, 6445 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 3278 - DNA, 2512 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggtttgggaagccagtctggagagcagggcctggctgaagggtggccttaccccggcagatcccttgtgccttccctctgtctcacattcgccttccttctccctgctccttttccctttccgtcctaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaatt

SEQ ID NO: 3279 - DNA, 2384 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaatt

SEQ ID NO: 3280 - DNA, 2722 bp, Homo sapiens
gagcaatgggaaagactggagtatctcagtccctctcagtggatgggggttgtgggagagaggcagctgggagacaggcctccctctggagttcatagctgagttgctgtccaaatcagtggtccctagaatctataaaacaaaactgagaacttcagaggtgcatccagagaagccacactccaaaaggaccacttccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgctgccgtgcaccgggcccgcgctgagcagcctccgcgccctggcgctcgccgggaatccgctgcgggcgctgcagccccgggccttcgcctgcttccccgcgctgcaactcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaactgcaacttgagttccttccctccttggaccctggattcctcccaggtcctatcgatcaacctctttggcaaccccctcacttgcagttgtgacttgtcttggctcctcacggatgcaaagagaactgtcctaagcagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggccagacgctgggcctgcagcgctgcgacacgcacctggtggcctacaaaaacccggcctttgatgattacccgctggggctccagaccgtcagttagcccagcttctgggataacgcgtctcatcgaactggatctgagcgcaaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgcaaaaaaaaaaaaaaaaaaaaaaaaaaaaaaaaataaaaaaaaaaaaaaaa

SEQ ID NO: 3281 - DNA, 2865 bp, Homo sapiens
agtggatgggggttgtgggagagaggcagctgggagacaggcctccctctggagttcatagctgagttgctgtccaaatcagtggtccctagaatctataaaacaaagctgagaacttcagaggtgcatccagagaagccacactccaaaaggaccacttccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaactgcaacttgagttccttccctccttggaccctggattcctcccaggtcctatcgatcaacctctttggcaaccccctcacttgcagttgtgacttgtcttggctcctcacggatgcaaagagaactgtcctaagcagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggccagacgctgggcctgcagcgctgcgacacgcacctggtggcctacaaaaacccggcctttgatgattacccgctggggctccagaccgtcagttagcccagcttctgggataacgcgtctcatcgaactggatctgagcgcaaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgccgccaggccttcttgtgtgttgttggttcatttgcggttttcagcagtcagtgcctctctatccagtagaatagtgtatggacgtaggaagggatgaaacagagaagttgcataacccagcctctttgatcatgttagaaatcacatcctcaggtctttccagcggaagctccttcatggtcaagctctaagacacaacgagctctgttattcaagaaatcaattccagt

SEQ ID NO: 3282 - DNA, 875 bp, Homo sapiens
cccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtta

SEQ ID NO: 3283 - DNA, 371 bp, Homo sapiens
agctgccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaagacataaccagccattggctgtttaaact

SEQ ID NO: 3284 - DNA, 815 bp, Homo sapiens
cccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtta

SEQ ID NO: 3285 - DNA, 8030 bp, Homo sapiens
gccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaa

SEQ ID NO: 3286 - DNA, 7758 bp, Homo sapiens
agcagcagcagcagcggtggccgcagtggcccctgcgcgtcgccagccccgagggaagcgcgctgcgcccacggggcgcgctgagcgcgcgcaacaggtgaccccctgccccggccctcgggccgtcccacgtccagccccctcggtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaa

SEQ ID NO: 3287 - DNA, 6331 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaagattatttctctggatgaagagagaactgtggtcttgcaaacagatcctttacctcctgctaggtttggagtcagtaaagagaagacgacttcaaccggcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgtcccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcttaggtggaaaacgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtaaa

SEQ ID NO: 3288 - DNA, 5289 bp, Homo sapiens
atacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccaacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatcccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttga

SEQ ID NO: 3289 - DNA, 5289 bp, Homo sapiens; identical to SEQ ID NO: 3288

SEQ ID NO: 3290 - DNA, 4262 bp, Homo sapiens
gtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatcattatttcattttaaaattagtgtttttcctagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaaacaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagaaaaaaaaa

SEQ ID NO: 3291 - DNA, 2905 bp, Homo sapiens
gaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgacttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctctgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcacatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaaaaaaaaaaaaaaaaaa

SEQ ID NO: 3292 - DNA, 5289 bp, Homo sapiens; identical to SEQ ID NO: 3288

SEQ ID NO: 3293 - DNA, 1592 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaagtttttgtatgaatatgcaagaaggcatcctgattactctgtctgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3294 - DNA, 1575 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3295 - DNA, 2151 bp, Homo sapiens; identical to SEQ ID NO: 3092

SEQ ID NO: 3296 - DNA, 2134 bp, Homo sapiens; identical to SEQ ID NO: 3096

SEQ ID NO: 3297 - DNA, 2106 bp, Homo sapiens
ccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccaggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaattgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3298 - DNA, 1141 bp, Homo sapiens
ccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaaggtattatgcaaaagaatagaaaaaaagagttcattatccaacctgattttgtccattttgtggctagatttagggaacctgagtgtctgatacaaactttccgacatggtcaaaaaagccttccttttatctgtcttgaaaatctttcatctttgaaggcctacactctcgtttcttcttttaagatttgccaatgatgatctgtcagaggtaatcactgtgcatgtgtttaaagatttcaccactttttatggtggtgatcactatagtgaaatactgaaacttgtttgtcaaattgcacagcaaggggacacagttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaattta

SEQ ID NO: 3299 - DNA, 2147 bp, Homo sapiens; identical to SEQ ID NO: 3098

SEQ ID NO: 3300 - DNA, 2227 bp, Homo sapiens; identical to SEQ ID NO: 3099

SEQ ID NO: 3301 - DNA, 673 bp, Homo sapiens
cctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatcctatccgtggtcctgaaccagttatgtgtgttgcatgagaaaacgccagtaagtgacagagtcaccaaatgctgcacagaatccttggtgaacaggcgaccatgcttttcagctctggaa

SEQ ID NO: 3302 - DNA, 2591 bp, Homo sapiens
cccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaa

SEQ ID NO: 3303 - DNA, 3033 bp, Homo sapiens
ccccggccccctgcggtctcccctcctccggacgctgcccctgccccacctgtggcgctcccgtcatctctagagcccccaaccagagtcctccagcccacccgcgaggctcgcgcacctgcgatgcggccccactagcagggacccgcccacctgtggcgctacccctgcctctgccgcctcccgcaccgctagcgcggcccccacctacgacgacccccgcgtagatgctcctgcccacacccgccccagccccggcccctgcccctagccgcgcccgcgccccctcccccgcagcccctcccatacgctcgggccccgcccgtcaccgcccattggcgctggggccgggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcagttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaattaaacatttgcctacaactccaa

SEQ ID NO: 3304 - DNA, 2618 bp, Homo sapiens
ggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccccggacaccccagcttgcgtcgtgtcactgaacgggaaccacgccgtgcgcctgccgctgatggagtgcgtgcagatgactcaggatgtgcagaaggcgatggacgagaggagatttcaagatgcagttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaattaaacatttgcctacaactccaa

SEQ ID NO: 3305 - DNA, 2955 bp, Homo sapiens
ccccggccccctgcggtctcccctcctccggacgctgcccctgccccacctgtggcgctcccgtcatctctagagcccccaaccagagtcctccagcccacccgcgaggctcgcgcacctgcgatgcggccccactagcagggacccgcccacctgtggcgctacccctgcctctgccgcctcccgcaccgctagcgcggcccccacctacgacgacccccgcgtagatgctcctgcccacacccgccccagccccggcccctgcccctagccgcgcccgcgccccctcccccgcagcccctcccatacgctcgggccccgcccgtcaccgcccattggcgctggggccgggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcagttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaattaaacatttgcctacaactccaa

SEQ ID NO: 3306 - DNA, 2663 bp, Homo sapiens
ggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcagttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaattaaacatttgcctacaactccaa

SEQ ID NO: 3307 - DNA, 3705 bp, Homo sapiens
gacaagagctcagacctgaggagagtgactagcttctctgtgtcccagtcccataggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtg

SEQ ID NO: 3308 - DNA, 3062 bp, Homo sapiens
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 3309 - DNA, 3705 bp, Homo sapiens; identical to SEQ ID NO: 3307

SEQ ID NO: 3310 - DNA, 3759 bp, Homo sapiens
cctcatattgccagacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggagtgagtcggggagatggtggtttagtgggggattcttggcttggaggaaggggatgatactctgttcccaaggtagccatggggctttagtgggatggggagcttctgggctgagccccaaaccacttccctttcccctccagcccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtg

SEQ ID NO: 3311 - DNA, 14321 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 3312 - DNA, 14641 bp, Homo sapiens
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 3313 - DNA, 2445 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3314 - DNA, 2640 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctg

SEQ ID NO: 3315 - DNA, 2367 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcaccaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3316 - DNA, 1935 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3317 - DNA, 1809 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3318 - DNA, 1970 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgctcttataatgcacatgagagcaacaaagtactcaatgttgtgtttgaccatt

SEQ ID NO: 3319 - DNA, 1964 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3320 - DNA, 1846 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 3321 - DNA, 1636 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggt

SEQ ID NO: 3322 - DNA, 2367 bp, Homo sapiens; identical to SEQ ID NO: 3315

SEQ ID NO: 3323 - DNA, 1964 bp, Homo sapiens; identical to SEQ ID NO: 3319

SEQ ID NO: 3324 - DNA, 1970 bp, Homo sapiens; identical to SEQ ID NO: 3318

SEQ ID NO: 3325 - DNA, 2445 bp, Homo sapiens; identical to SEQ ID NO: 3313

SEQ ID NO: 3326 - DNA, 1614 bp, Homo sapiens
atcttttcctttctgcccttggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatcccaaacacgaagcgctccaggggctttgggtttgtcacatatgccactgtggaggaggtggatgcagctatgaatgcaaggccacacaaggtggatggaagagttgtggaaccaaagagagctgtctccagagaagattctcaaagaccagatgcccacttaactgtgaaaaagatatttgttggtggcattaaagaagacactgaagaacatcacctaagagattattttgaacagtatggaaaaattgaagtgattgaaatcatgactgacagaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacgaaaccaagtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtataggcaaaaaactcgaggactgtatttgtgactaattgtataacaggttattttagtttctgttctgtggaaagtgtaaagcattccaacaaagggttttaatgtagattttttttttttgcaccccatgctgttgattgctaaatgtaatagtctgatcgtgacgctggataaatgtcttttttttttaaaaaaaaaaaaagatctttgcagaacacctattaattaattaattaattcactcattcagcaacatttttgagctgctgccctgttttcatgatgtgctacatgatagatttgtaaacacctgtctcaataaacttatagttgtgttggaataggtattattctcagttgcatcttcatgaaactcataataaattggtaataattacaatgtaagaaggattctgaggccacagaaagaatga

SEQ ID NO: 3327 - DNA, 1481 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccagtgattgttggcacatcctatgcaatatatctaaattgaataatggtaccagataaaattatagatgggaatgaagcttgtgtatccattatcatgtgtaatcaataaacgatttaattctcttgaatgaaatgacaac

SEQ ID NO: 3328 - DNA, 1382 bp, Homo sapiens
gtgggcggacccgtggacaccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacgtatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagactgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccatggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacgaaaccaagtggctatggcggttccagcagcagcagtagctatggcagtggcagaagattttaattaggaaacaaagcttagcaggagaggagagccagagaagtgacagggaagctacaggttacaatagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaacgtagatttctttttgcaccccatgctgttgattgctaaatgtaatagtctgatcgtgatgctgaataaatgtcttttttttttaaaaaaaaaaaaagaaagaaaaa

SEQ ID NO: 3329 - DNA, 2177 bp, Homo sapiens
tcctttctgcccgtggacgccgccgaagaagcatcgttaaagtctctcttcaccctgccgtcatgtctaagtcagaggtgagttaggcgcctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3330 - DNA, 1358 bp, Homo sapiens
cctttctgcccttggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacacgaagcgctccaggggctttgggtttgtcacatatgccactgtggaggaggtggatgcagctatgaatgcaaggccacacaaggtggatggaagagttgtggaaccaaagagagctgtctccagagaagattctcaaagaccagatgcccacttaactgtgaaaaagatatttgttggtggcattaaagaagacactgaagaacatcacctaagagattattttgaacagtatggaaaaattgaagtgattgaaatcatgactgacagaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttggcaattacaacaatcagtcttcaaattttggacccatgaagggaggaaattttgaaggcagaagctctggcccccatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtataggcaaaaaactcgaggactgtatttgtgactaattgtataacaggttattttagtttctgttctgtggaaagtgtaaagcattccaacaaagggttttaatgtagattttttttttttgcaccccatgctgttgattgctaaatgtaatagtctgatcgtgacgctggataaatgtctttttt

SEQ ID NO: 3331 - DNA, 2287 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggtaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3332 - DNA, 2348 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3333 - DNA, 2131 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3334 - DNA, 1866 bp, Homo sapiens
tagcctctccagatacgtttgtcagcttgctcctttctgcctgtggatgccaacaaagaagcatcattaaagtctctcttctcccttccgtcgtgtctaagtcagagtctcctaaagagcccgaatagctgaggaagctcttcattggagagttgaggtttgaaacaaccgacgagagcctgaggagccattttgagcgatggggaatgctcacagactgtgcggtaatgagagatccaaacaccaagcgctccaggggctttgggtttgttacatacgccactgtggaggaggtggatgcagccacgaatgcaaggccacacaaggtggatggaaaagttgtggaaccaaggagaactgtctcaagagaagattatcaaagatcaggtgcccacttaactgtgaaaaagatatttgttggtggcattaaagaaaacactgaaaaacatcagctaagagattattttgaacagcatggaaaaatggaagtgattgaaatcatgactgaggcagtggcaagaaaaggggctttgcctttgtaacctttgacgaccatgactccatggataagattgtcattccgaaataccatactgtgaatggccacaactgtgaagttaggaaagccctgtcaaagcaagagatggctagtgcttcttccagccaaagaggtcaaagtggttctggaaactttggtggtggttgtggaggtggtttctgtgggaatgacaactttggtcatggaggaaacgtcagtggtcgtggtggctttggtggcagccatggtggtggtggatatggtggcagtggggatggctataatggatttggtaatgatggaagcaatttggaggtggtggaagctacaatgattttggcaattacaacagtcagtcttcaaattttggacccgtgaagggaggaaactttggggcagaagctctggcccctatggtggcggaggccaatactttgccaaaccaccaaaccacagtggctatggtggttccagtagcagcagtagctatggcagtggcagaagatgttaattaggaaacagagcttagcaggagaggagagccagagaagtgacagggaagctgcagtttacaacagattcgtgaactcagccaagcacagtggtgacagggcctagctgctacaaagaagacatattttagacaaatattcatgtgtatgggcaaaaaacttgaggactgtatttgtgactaattgtataacaggttattttagtttctgttctgtggaaagtgtaaagcatttcaacaaagggttttaatgtagatttttttccttgcacccatgttgttgattgctaaatgtaatagtctgatcgtgacgctgaataaatgtctttttttttttaatgtgctgtgtaaagttagtctactctgaagccatcttggtaaatttccccagcagtgtgaagttggaattccttcagggtgatgccaggttctatttggaatttacatacaacctgcttgggtggagaagccattgtcttcagaaaccttggtgtaattgaattgatagttactgttgtgacctgaagttcaccattaaaagggactacccaagcaaaatcatggaattattggttataaaaatgattgttggcacatcctatgcaatatatctaaattgaataatggtaccagataaaattatagatgggaatgaagcttgtgtatcatccattatcatgtgtaatcaataaacaatttaattctcttgaatgaaatgacaactctatggatttgggaatggcagagatttggactttccttacccactacccctgattatgttgaatgcttctatcacaattcaagttcaaagctc

SEQ ID NO: 3335 - DNA, 1302 bp, Homo sapiens
aagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgaaacttcagtggtcgtggtggctttggtggcagccgtgctggtggtagatatggtggcagtggggatggctctaatggatttggtaatgatggaagcaattttggaggtggtggaagctacaatgattttggcaattacaacaatcagtcttcaaattttggacccatgaagggaggaaattttggaggcagaaactctggcccctatggcggtggaggccagtactttgcaaaaccacgaaaccaaggtggctatggcggttccagcagcagcagtagctgtgtcagtggcagaagattttaattttgtgaactcagccaagcacagtggtggcagggcctagctgctacaaagaagacatgttttagacaaatactcatgtgtatgggcaaaaaactcgaggactgtgtttgtgactaattgtataacaggttattttagtttctgttctgtggaaagtgtaaagcattccaacaaagcgttttaatgtagattttttttttttgcacccatgctgttgattgctaaatgtaatagtctgatcgtgacgctgaataaatgtctttttttttttaatgtgctgtgtaaagttagtctactctgaagccatcttggtaaatttccccaacagtgtgaagttagaattccttcagggtgatgccagtgattgttggcacatcctatgcaatatatctaaattgaataatggtaccagataaaattatagatgggaatgaagcttgtgtatcatccattatcatgtgtaatcaataaacaatttaattctcttgaatgaaaaaaaa

SEQ ID NO: 3336 - DNA, 2131 bp, Homo sapiens; identical to SEQ ID NO: 3333

SEQ ID NO: 3337 - DNA, 1609 bp, Homo sapiens
ctttctgcccttggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatcccaaacacgaagcgctccaggggctttgggtttgtcacatatgccactgtggaggaggtggatgcagctatgaatgcaaggccacacaaggtggatggaagagttgtggaaccaaagagagctgtctccagagaagattctcaaagaccagatgcccacttaactgtgaaaaagatatttgttggtggcattaaagaagacactgaagaacatcacctaagagattattttgaacagtatggaaaaattgaagtgattgaaatcatgactgacagaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagagggagaatgcaaggacctgagcttctcttcctcaagcccctcacagcgactgggcctttacaactcaatgttcgaagctctgcccggggacagtctgccatgtcactttgtggtgcattacaaagtgtagtcaatgcgctaagggctgtgcggactttccttcgctgcgtggatcaggatgcaagatggacttccccccaccctccgaatcagtctgttcctcctggggccattcagctgacagctgcggaaaggacagcgcctgctgaaaaagggtccataatttccctctggcaagagacggcagcccaactttggaggggacaattagcgtgctctcagctggaacaatggggagcagcaacagatgcttctcgtcccagggacgctccgaaccgcagcctcctgctaatgggaggctttcttcttccctgcccgggaaacctggcagccttgccagcagctcgggtagggtgggggtgggtttggctgctgagctggaaggagagcagcattatcagcgcaaaccagaggagcggggcctgcaggagctgctctcaggactccaccatggcgggctttctgggaagcactgactttgtcttggattacttcttgagtgaggttgtggggtgcaaatttgggacggcagaggggcatggttactcactctcactgaaggtagaagagacccacatggcaatgatcagggatactgaccactgcttggagacctctggcaccaagtctcagcttccacagctggaaaatggactctgcctgttctgtgccagccactatgaggcagaagagccgggctttgacaaaggacccttggaagaccagcttcggtctatgctgtaccgcaccccctctacccgcctatggtctggaaccactgtggttgctgcccttcctcctgcctcttccagctccctcctcgtcctcagcccccaaccctgccat

SEQ ID NO: 3338 - DNA, 1941 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaaaaaaaaaaaaa

SEQ ID NO: 3339 - DNA, 2192 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3340 - DNA, 939 bp, Homo sapiens
atgtctaagtcagagtttcataaagagcctgaacagctgagaaagctcttcattggagggttgagctttgaaacaaccgatgagtgtttgaggagccattttgagcaatggggaaagctcacagactgtgtgataatgagagacccaaacaccaagcactcctgaggctttgggtttgtcacaaatgccactgtggaggaggtggatgcagccatgaatgcaaggtcacacaaggtggatgaaagagttgtggaaccaaaaggagctgactcaagagaagactctcaatgaccaggtgcccacttaactgtgaaaaagatatttgttggtggcattaaagaagacactgaagaacatcatctaaaagattattaagtgattgaaatcatgactgacagaggccgtggcagggaaacaggctttgcctttgtaacctttgatgaacatgactccatgaataagactgtcattcagaaataccatactgtaaatggccacaactgtgaagttaggaaagccctgtcaaagcaagagatggctagtgtttcatccagccaaagaggttgaagtggttctggaaactttggtggtggttgtggaggtgattttggtgggaatgacaactttgttcatggaggaaacttcagtggtagtggtggctttggtggcaactgtgttggtggtggatatggtggcagtgaggatggctacaatggatatggtaaaaatggaagcaattttggacatggtggaagctacaatgattttgacaattacaacaatcagtcttcaaattttggacccatgaaaggatgaaactttggaggcagaagctctggcccctatggtggtggagaccaatacgttgccaaaccacaaaaccaaggtggctctggcggtttcagtagtggcagtagctatggctgtggcagaagattt

SEQ ID NO: 3341 - DNA, 1749 bp, Homo sapiens
ttctggcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcatggaggaaacttcagtggtcgtggtggctttggtggcagccgtgctggtggtagatatggtggcagtggggatggctctaatggatttggtaatgatggaagcaattttggaggtggtggaagctacaatgattttggcaattacaacaatcagtcttcaaattttggacccatgaagggaggaaattttggaggcagaaactctggcccctatggcggtggaggccagtactttgcaaaaccacgaaaccaaggtggctatggcggttccagcagcagcagtagctgtgtcagtggcagaagattttaattaggaaacaaagcttagcaggagaggagagccagagaagtgacagggaagccacaggttacaacagatttgtgaactcagccaagcacagtggtggcagggcctagctgctacaaagaagacatgttttagacaaatactcatgtgtatgggcaaaaaactcgaggactgtgtttgtgactaattgtataacaggttattttagtttctgttctgtggaaagtgtaaagcattccaacaaagcgttttaatgtagattttttttttttgcacccatgctgttgattgctaaatgtaatagtctgatcgtgacgctgaataaatgtctttttttttttaatgtgctgtgtaaagttagtctactctgaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaaacaaagtcatggaatggttataaaagtgattgttggcacatcctatgcaatatatctaaattgaataatggtaccagataaaattatagatgggaatgaagcttgtgtatcatccattatcatgtgtaatcaataaacaatttaattctcttgaatgaaaaaaaaa

SEQ ID NO: 3342 - DNA, 1749 bp, Homo sapiens; identical to SEQ ID NO: 3341

SEQ ID NO: 3343 - DNA, 2011 bp, Homo sapiens
aaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacgctgaataaatgtctttttttttttaatgtgctgtgtaaagttagtctactctgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaa

SEQ ID NO: 3344 - DNA, 1420 bp, Homo sapiens
atggaggccccgcaagacagacccatcattgtttttgttgttgatctttcacctgtggtgctggccttcacttccatttgctgcctctccctgtgtctccttggagctctcgccatcttgtggcagctgaggaagctcttcattggagagttgaggtttgaaacaaccgacgagagcctgaggagccattttgagcgatggggaatgctcacagactgtgcggtaatgagagatccaaacaccaagcgctccaggggctttgggtttgttacatacgccactgtggaggagaaaaggggctttgcctttgtaacctttgacgaccatgactccatggataagattgtcattccgaaataccatactgtgaatggccacaactgtgaagttaggaaagccctgtcaaagcaagagatggctagtgcttcttccagccaaagaggtcaaagtggttctggaaactttggtggtggttgtggaggtggtttctgtgggaatgacaactttggtcatggaggaaacgtcagtggtcgtggtggctttggtggcagccatggtggtggtggatatggtggcagtggggatggctataatggatttggtaatgatggaagcaatttggaggtggtggaagctacaatgattttggcaattacaacagtcagtcttcaaattttggacccgtgaagggaggaaactttggggcagaagctctggcccctatggtggcggaggccaatactttgccaaaccaccaaaccacagtggctatggtggttccagtagcagcagtagctatggcagtggcagaagatgttaattaggaaacagagcttagcaggagaggagacagtggtgacagggcctagctgctacaaagaagacatattttagacaaatattcatgtgtatgggcaaaaaacttgaggactgtatttgtgactaattgtataacaggttattttagtttctgttctgtggaaagtgtaaagcatttcaacaaagggttttaatgtagatttttttccttgcacccatgttgttgattgctaaatgtaatagtctgatcgtgacgctgaataaatgtctttttttttttaatgtgctgtgtaaagttagtctactctgaagccatcttggtaaatttccccagcagtgtgaagttggaattccttcagggtgatgccaggttctatttggaatttacatacaacctgcttgggtggagaagccattgtcttcagaaaccttggtgtaattgaattgatagttactgttgtgacctgaagttcaccattaaaagggactacccaagcaaaatcatggaattattggttataaaaatgattgttggcacatcctatgcaatatatctaaattgaataatggtaccagataaaattatagatgggaatgaagc

SEQ ID NO: 3345 - DNA, 2183 bp, Homo sapiens
taaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacc

SEQ ID NO: 3346 - DNA, 1524 bp, Homo sapiens
tctcatatgccaccttctcaaaaaggacttccctgatcactctatttaaaatagcctctccagatacgtttgtcagcttgctcctttctgcctgtggatgccaacaaagaagcatcattaaagtctctcttctcccttccgtcgtgtctaagtcagagtctcctaaagagcccgaatagctgaggaagctcttcattggagagttgaggtttgaaacaaccgacgagagcctgaggagccattttgagcgatggggaatgctcacagactgtgcggtaatgagagatccaaacaccaagcgctccaggggctttgggtttgttacatacgccactgtggaggaggtggatgcagccacgaatgcaaggccacacaaggtggatggaaaagttgtggaaccaaggagaactgtctcaagagaagattatcaaagatcaggtgcccacttaactgtgaaaaagatatttgttggtggcattaaagaaaacactgaaaaacatcagctaagagattattttgaacagcatggaaaaatggaagtgattgaaatcatgactgaggcagtggcaagaaaaggggctttgcctttgtaacctttgacgaccatgactccatggataagattgtcattccgaaataccatactgtgaatggccacaactgtgaagttaggaaagccctgtcaaagcaagagatggctagtgcttcttccagccaaagaggtcaaagtggttctggaaactttggtggtggttgtggaggtggtttctgtgggaatgacaactttggtcatggaggaaacgtcagtggtcgtggtggctttggtggcagccatggtggtggtggatatggtgtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcaccc

SEQ ID NO: 3347 - DNA, 3530 bp, Homo sapiens
ggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcagggttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatcca

SEQ ID NO: 3348 - DNA, 3529 bp, Homo sapiens
ggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcaggttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatcca

SEQ ID NO: 3349 - DNA, 3515 bp, Homo sapiens
ggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatcca

SEQ ID NO: 3350 - DNA, 3419 bp, Homo sapiens
ttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatgagatggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagctctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggagtcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagaggagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacagggtatgctgcctctgtaaattcatgtattcaaaggaaaagacaccttgcctataattaaaatgtggaactataaaattttttaaaatccaaaaaaaaaaaaaaa

SEQ ID NO: 3351 - DNA, 1577 bp, Homo sapiens
aaggctgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtgacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 3352 - DNA, 1670 bp, Homo sapiens
aaggctgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtgacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 3353 - DNA, 1525 bp, Homo sapiens
tcatggaagcggaggggtagtcctgaccccgcgtgggtcctgacgccgagattaagacgagtggccatttaggaggatgtggaccctggacgctcgtggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtgacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 3354 - DNA, 1128 bp, Homo sapiens
ttctcctctagaatgcatgtgaattgggaacaggttccttcttatgttgttcagcagcataaatcatacagaaagcggggtcctgccggcacagactgcaccaggagcgacttctcctcttccaagttatctgagaacaaagttaggacacgcggtgagggtgggggaggggccggggctccacacctgaaagtccctcaggtccgtgctgggtggctttttccgtaactctgcacacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttag

SEQ ID NO: 3355 - DNA, 1104 bp, Homo sapiens
caggaagctggacgctgcagctggaactagcgtgccaaggtagagtaaggaagacttagctggtgttgggcttggcgggtccacttggtacgctgggcaaactccaattatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccagg

SEQ ID NO: 3356 - DNA, 3107 bp, Homo sapiens
caggaagctggacgctgcagctggaactagcgtgccaaggtagagtaaggaagacttagctggtgttgggcttggcgggtccacttggtacgctgggcaaactccaattatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataa

SEQ ID NO: 3357 - DNA, 3107 bp, Homo sapiens; identical to SEQ ID NO: 3356

SEQ ID NO: 3358 - DNA, 3107 bp, Homo sapiens; identical to SEQ ID NO: 3356

SEQ ID NO: 3359 - DNA, 3464 bp, Homo sapiens
cagcctcccttttgttggcgctgggagagaatgtgggcatgggggtggggaggcgcgaagctccgaggccgggccgcggatactttaaagctcagagctgggagggcccaaaggaaggggcggcgtccacatggttacccttctgctgcgcgggtcaagtagcttcttctggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaaaaaaaaaaaaaaa

SEQ ID NO: 3360 - DNA, 3107 bp, Homo sapiens; identical to SEQ ID NO: 3356

SEQ ID NO: 3361 - DNA, 4915 bp, Homo sapiens
cttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccttttctttcttcagcggcatctgctagctcgtctacccctgttccattgtctccaccagatacaacttggcctcttcctgcccttgcaaccacagaaccagctagtgagggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtg

SEQ ID NO: 3362 - DNA, 5968 bp, Homo sapiens
cttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattg

SEQ ID NO: 3363 - DNA, 2960 bp, Homo sapiens
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacacacacacacaattctaggctagtttctggtcttatcattgagttacagcttagtgatgattttaagacaaaacaaacaaacaaaaaaaaaaaaaaaccatggtacccggatcctcgaattc

SEQ ID NO: 3364 - DNA, 6754 bp, Homo sapiens
cttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagctgcctgccgacactacggccactgtcgaggacatgctgccttctgtcaccaccgtcaccactaactctgacactatcaccgaaacctttgccactgctcagaacagccccaccagtgagaccaccaccctgacctccagtattgccccgccggccacggccacgcctgactcaaactctgtaccggctggccaggccaccccttccaaggggcccagcgcctctgccccctccccggccccagcttcagcccccaaggtcgcccccctcgttgacctgagcgacaccccgacctcaacccctgccgctagcaatttgtcttctagtgtcctggctaaccaaggggctgtcctcagcccaagcgcccctgctggtgtcggggaggcctctaaggctcctccggccagcaagcccacccctgcaccagtccccaccccgactggggcagccagtcctctagcagcagcggctgcccctgccacagaagcccctcaggccaagcaggaggctcccagcaccaaaggcccggacccggagcccacccagcccggagccgcgaagagcccggccgaggcagccacagcccttgctagcccgaagagcgaggctgcctccgtcagcaccacaaacccttcccagggcgaggactttaaaatggacgaagggaacttcaagaccccagatattgaccttgcaaaggatgtttttgcagccctgggctctcctgctcccgccgctggggccagtggacaagcccctgagcttgctccttccactgcagacagctctgtttcgcctgcgccagcaaagaccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattg

SEQ ID NO: 3365 - DNA, 5938 bp, Homo sapiens
cttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattg

SEQ ID NO: 3366 - DNA, 5136 bp, Homo sapiens
cttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtg

SEQ ID NO: 3367 - DNA, 6164 bp, Homo sapiens
tgttagggagtatggaaatgttggggccagtgccatggttgtatgttgagggagtgaaactctcttctcaggttcaggagaaggtattacaagaagaggaacccatacccagacagccctgctgttgtcctgcattgttgagggaggaattatgtcctatgtgtttgtagtaacagaatccacagctaagaaaagacaagctcaggagggaagtccttgggtagatgctaaagagccttctctttgttctttgtgccagaagctataggtttctaattatgatggcaggagaagtgtccttatgaagtgtgtcgctgtgtataaaaatatctctatgttttgttattgctgtgttctttgtgtgatagatgttattaggagcacactctgtcctttccaaggacgtaatctgactgttttctgtttcctcttcttttttgctttgctttccaacctgatgatgtgctgctgtgttctgttgcaatgaaattccttcatctgtttcacatcgcaacaaaaagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagctgcctgccgacactacggccactgtcgaggacatgctgccttctgtcaccaccgtcaccactaactctgacactatcaccgaaacctttgccactgctcagaacagccccaccagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattg

SEQ ID NO: 3368 - DNA, 5938 bp, Homo sapiens; identical to SEQ ID NO: 3365

SEQ ID NO: 3369 - DNA, 5968 bp, Homo sapiens; identical to SEQ ID NO: 3362

SEQ ID NO: 3370 - DNA, 4871 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgcacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgtgtgtgtatatataaaataaaaaactcctctacttgtactttggcattcaatttttagaaattcagtctcaaatgccatt

SEQ ID NO: 3371 - DNA, 4871 bp, Homo sapiens; identical to SEQ ID NO: 3370

SEQ ID NO: 3372 - DNA, 3651 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtgaatatccaggtagtaattctagaagccatatataaaagatataactaaaggaactactttgcctaaatacttcccccaatatgatgcatcaatatgaagcatttgtgaatctgctgccctgatttcttccttctctacctccaaacaggatttttttcctgctaaatggtgagggatactgctcatttcctgacagccagtacttgtaacagcaccagtcatttctaagttaatacaaatgtgtaattatacttaaagctg

SEQ ID NO: 3373 - DNA, 3321 bp, Homo sapiens
atgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaagctggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagagactggagcat

SEQ ID NO: 3374 - DNA, 2260 bp, Homo sapiens
gcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaac

SEQ ID NO: 3375 - DNA, 2375 bp, Homo sapiens
gcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagctttttgcacagccagagaacaacacatcacacacaggaaacagttgtgctcatgtgatgggggcctcagcactaggaaggagcggactattggtgcacgcagcagcttgaataaatctgaaagtcactatgctgtgtaagagaagccaaattttaaaagtgcatactgtgtacagagggtgtcgagaatgcctcctacgtgacggaaagcagatccgtggttccctgcagactggcaggagcagattccaaaggcacaggaagaagcttgtgggtagagtgtgttcattatcttct

SEQ ID NO: 3376 - DNA, 2375 bp, Homo sapiens; identical to SEQ ID NO: 3375

SEQ ID NO: 3377 - DNA, 2488 bp, Homo sapiens
ggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 3378 - DNA, 2390 bp, Homo sapiens
cgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctcatctcatcttgcattctgatcaattggcaagaaagg

SEQ ID NO: 3379 - DNA, 2821 bp, Homo sapiens
cgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggccacaggag

SEQ ID NO: 3380 - DNA, 2372 bp, Homo sapiens
cgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctcatctcatcttgcattctgatcaattggcaagaaagg

SEQ ID NO: 3381 - DNA, 2390 bp, Homo sapiens; identical to SEQ ID NO: 3378

SEQ ID NO: 3382 - DNA, 2372 bp, Homo sapiens; identical to SEQ ID NO: 3380

SEQ ID NO: 3383 - DNA, 2372 bp, Homo sapiens; identical to SEQ ID NO: 3380

SEQ ID NO: 3384 - DNA, 2390 bp, Homo sapiens; identical to SEQ ID NO: 3378

SEQ ID NO: 3385 - DNA, 2881 bp, Homo sapiens
tgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcca

SEQ ID NO: 3386 - DNA, 2390 bp, Homo sapiens; identical to SEQ ID NO: 3378

SEQ ID NO: 3387 - DNA, 3134 bp, Homo sapiens
gcagtgatgcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggctcttctccagtgacacgtggacaaatgcgggctcatcagcccccccagagagggtcaggccgaacc

SEQ ID NO: 3388 - DNA, 4436 bp, Homo sapiens
gcagtgatgcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagaggcaagtcataacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagaggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaacaacagccaccaggcagcttatcaaagcaagagggcatccgttcacaggacaggggctcccagcaattcccagtggcagtgggggggtggctgggccaagccagccactcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtcccacagcacaggccagaaggctggatacctgaactgccaaaggagtgtgggcaggtgctacacagcaggtgcaacccagctcccaaaattgggcaggctgtgcacagaggccctgcaggccc

SEQ ID NO: 3389 - DNA, 3432 bp, Homo sapiens
actccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctatgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctgccggccgtggtgagttgtgtgcctgggcaggtcttcagccctgacggaccctcgagattccggaaagcatacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctctccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatg

SEQ ID NO: 3390 - DNA, 4287 bp, Homo sapiens
tccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaacaacagccaccaggcagcttatcaaagcaagagggcatccgttcacaggacaggggctcccagcaattcccagtggcagtgggggggtggctgggccaagccagccactcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtcccacagcacaggccagaaggctggatacctgaactgccaaaggagtgtgggcaggtgctacacagcaggtgcaacccagctcccaaaattgggcaggctgtgcacagaggccctgcaggccc

SEQ ID NO: 3391 - DNA, 1089 bp, Homo sapiens
atgctggtcatggcgccccgaaccgtcctcctgctgctctcggcggccctggccctgaccgagacctgggccggctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 3392 - DNA, 1098 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagacacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctccccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtga

SEQ ID NO: 3393 - DNA, 1591 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgc

SEQ ID NO: 3394 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 3395 - DNA, 3394 bp, Homo sapiens
tggtgtaggagaagagggatcaggacgaagtcccaggtcccgggcggggctctcagggtctcaggctccaagggccgtgtctgcattggggaggcgccgcgttggggattctccactcccctgagtttcacttctcccaacctgcgtcgggtccttcttcctgaatactcatgacgcgtccccaattcccactcccattgggtgtcgggttctagagaagccaatcagcgtctccgcagtcccggttctaaagtccccagtcacccacccggactcacattctccccagaggccgagatgcgggtcatggcgccccgagccctcctcctgctgctctcgggaggcctggccctgaccgagacctgggcctgtgagtgcggggttgggagggaagcggcctctgcggagaggagcgaggggccctcccggcgagggcgcaggacccggggagccgcgcagggaggtgggtcgggcgggtctcagcccctcctcgcccccaggctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacggtgagtgaccccggcccggggcgcaggtcacgacccctccccatcccccacggacggcccgggtcgccccgagtctccccgtctgagatccaccccgaggctgcggaacccgcccagaccctcgaccggagagagccccagtcacctttacccggtttcattttcagtttaggccaaaatccccgcgggttggtcgggactggggcggggctcgggggacggggctgaccacgggggcggggccagggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgggtaccaggggcagtggggagccttccccatctcccgtagatctcccgggatggcctcccacgaggaggggaggaaaatgggatcagcgctagaatatcgccctcccttgaatggagaatgggatgagttttcctgagtttcctctgagggccccctctgctctctaggacaattaagggatgaagtccttgaggaaatggaggggaagacagtccctggaatactgatcaggggtcccctttgaccactttgaccactgcagcagctgtggtcaggctgctgacctttctctcaggccttgttctctgcctcacgctcaatgtgtttgaaggtttgattccagcttttctgagtccttcggcctccactcaggtcaggaccagaagtcgctgttcctccctcagagactagaactttccaatgaataggagattatcccaggtgcctgtgtccaggctggcgtctgggttctgtgcccccttccccaccccaggtgtcctgtccattctcaggatggtcacatgggcgctgttggagtgtcgcaagagagatacaaagtgtctgaattttctgactcttcccatcagaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatggagtaaggagggggatgaggggtgatgtgtcttctcagggaaagcagaagtcctggagcccttcagccgggtcagggctgaggcttggaggtcagggcccctcaccttcccctcctttcccagagccgtcttcccagcccaccatccccatcgtgggcatcgttgctggcctggctgtcctggttgtcctagctgtcctaggagctgtggtggctgttgtgatgtgtaggaggaagagctcaggtagggaaggggtgaggagtggggtctgggttttcttgttccactgggagtttcaagccccaggtagaagtgtgccccacctcgttactggaagcaccatccacacatgggccatcccagcctgggaccctgtgtgccagcacttactctgttgtgaagcacatgacaatgaaggacagatgtatcaccttgatgattatggtgttggggtccttgattccagcattcatgagtcaggggaaggtccctgctaaggacagaccttaggagggcagttgcttcagaacccacagctgctttccccgtgtttcctgatcctgccctgggtctgcagtcatagttctggaaacttctcttgggtccaagactaggaggttcccctaagatcgcatggccctgcctcctccctgtcccctcacagggcattttcttcccacaggtggaaaaggagggagctgctctcaggctgcgtgtaagtgatggcggtgggcgtgtggaggagctcacccaccccataattcctcttgtcccacatctcctgcgggctctgaccaggtctttttttttgttctaccccagccagcaacagtgcccagggctctgatgagtctctcatcgcttgtaaaggtgagattctggggagctgaagtggtcgggggtggggcagagggaaaaggcctaggtaatggggatcctttgattgggacgtttcgaatgtgtggtgagctgttcagagtgtcatcacttaccatgactgacctgaatttgttcatgactattgtgttctgtagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccga

SEQ ID NO: 3396 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 3397 - DNA, 1591 bp, Homo sapiens; identical to SEQ ID NO: 3393

SEQ ID NO: 3398 - DNA, 1578 bp, Homo sapiens
ggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatatgcagcacgaggggctgccagagcccctcaccctgagctgggagccatcttcccagcccaccatccccatcatgggcatcgttgctggcctggctgtcctggctgtcctagctgtcctaggagctgtgatggctgttgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 3399 - DNA, 1100 bp, Homo sapiens
atgcgggtcatggcgccccgaaccctcatcctgctgctctcgggagccctggccctgaccgagacctgggccggctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgttcagcacgaggggctgccggagcccctcaccctgagatggaagccgtcttcccagcccaccatccccatcgtgggcatcgttgctggcctggctgtcctggctgtcctagctgtcctaggagctatggtggctgttgtgatgtgtaggaggaagagctcaggtggaaaaggagggagctgctctcaggctgcgtccagcaacagtgcccagggctctgatgagtctctcatcgcttgtaaagcctg

SEQ ID NO: 3400 - DNA, 1093 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacgacacccagttcgtgaggttcgacagcgacgccgcgagtccgaggacggagccccgggcgccgtggatagagcaggaggggccggagtattgggaccgggagacacagatctccaagaccaacacacagacttaccgagaggacctgcggaccctgctccgctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaag

SEQ ID NO: 3401 - DNA, 1089 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 3402 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 3403 - DNA, 1098 bp, Homo sapiens
atggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtga

SEQ ID NO: 3404 - DNA, 1578 bp, Homo sapiens; identical to SEQ ID NO: 3398

SEQ ID NO: 3405 - DNA, 1524 bp, Homo sapiens
atgcgggtcatggagccccgaaccctcatcctgctgctctcgggagccctggccctgaccgagacctgggcctgctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaaccgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgaggcggaggagcggagagcctacctggagggcacgtgcgtggagtggctccgcagatacctggagaacgggaaggagagcctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttctaaagcctgagacagctgcctgtgtgggactgagatgcaggatttcctcacacctctcctttgtgacttcaagagcctctggcatctctttctgcaaaggcatctgaatgtgtctgcgttcctgttagcataatgtgaggaggtggagagacagcccacccccgtgtccacgtgacccctgtccccacactgacctgtgttccctccccgatcatctttcctgttccagagaagtgggctggatgtctccatctctgtctcaacttcatggtgcgctgacgtgcaacttcttacttccctaatgaagttaagaacctgaatataaatttgttttctcaaatatttgctatgaagggttgatggattaattaaataagtcaattcctggaagttgagagagcaaataaagacctgagaaccttccagaatccgc

SEQ ID NO: 3406 - DNA, 1567 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcaccttccaccatgaccctcttcccacgctgacctgtgctccctccccaatcatctttcctgttccagag

SEQ ID NO: 3407 - DNA, 1541 bp, Homo sapiens
attcggattctccccagacgccgaggatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgagcacctgcgctcctgcaccgccgccgacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttcc

SEQ ID NO: 3408 - DNA, 1101 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3409 - DNA, 1567 bp, Homo sapiens; identical to SEQ ID NO: 3406

SEQ ID NO: 3410 - DNA, 1591 bp, Homo sapiens; identical to SEQ ID NO: 3393

SEQ ID NO: 3411 - DNA, 1089 bp, Homo sapiens
atgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 3412 - DNA, 1098 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgccacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtga

SEQ ID NO: 3413 - DNA, 1089 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 3414 - DNA, 1567 bp, Homo sapiens; identical to SEQ ID NO: 3406

SEQ ID NO: 3415 - DNA, 1591 bp, Homo sapiens; identical to SEQ ID NO: 3393

SEQ ID NO: 3416 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 3417 - DNA, 2543 bp, Homo sapiens
acgccgagatgcgggtcacggcgccccgaaccctcctcctgctgctctggggggcagtggccctgaccgagacctgggccggtgagtgcgggatcgggagggaaatggcctctgtggggaggagcgaggggaccgcaggcgggggcgcaggacccggggagccgcgccgggaggagggtctggcgggtctcagcccctcctggcccccaggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgggtaccaggggcagtggggagccttccccatctcctatagacgccgagatgctggtcatggcgccccgaaccgtcctcctgctgctctcggcggccctggccctgaccgagacctgggccgaccccccaaagacacacgtgacccaccaccccatctctgaccatgaggccaccctgaggtgctgggccctgggcttctaccctgcggagatcacactgacctggcagcgggatggcgaggaccaaactcaggacactgagcttatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatatgcagcacgaggggctgccagagcccctcaccctgagctgggagccatcttcccagcccaccatccccatcatgggcatcgttgctggcctggctgtcctggctgtcctagctgtcctaggagctgtgatggctgttgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 3418 - DNA, 1098 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtga

SEQ ID NO: 3419 - DNA, 1098 bp, Homo sapiens
atggccgtcatggcgccccgaaccctcctcctgctactcttgggggccctggccctgacccagaccagggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtga

SEQ ID NO: 3420 - DNA, 1101 bp, Homo sapiens
atgcgggtcatggcgccccgaaccctcatcctgctgctctcgggagccctggccctgaccgagacctgggcctgctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagagcctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3421 - DNA, 1098 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacaggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcc

SEQ ID NO: 3422 - DNA, 1101 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctcgctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3423 - DNA, 1101 bp, Homo sapiens
atgcgggtcatggcgccccgaaccctcatcctgctgctctcgggagccctggccctgaccgagacctgggcctgctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3424 - DNA, 1703 bp, Homo sapiens
cgagtttcacttcttctcccaacctatgtcgggtccttcttccaggatactcgtgacgcgtccccatttcccactcccattgggtgtcgggtgtctagagaagccaatcagtgtcgccggggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgc

SEQ ID NO: 3425 - DNA, 1101 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3426 - DNA, 1101 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3427 - DNA, 1101 bp, Homo sapiens
atgcgggtcatggcgccccgaaccctcatcctgctgctctcgggagccctggccctgaccgagacctgggcctgctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 3428 - DNA, 1128 bp, Homo sapiens
gtgaaggcccagtcacagactcaccgagtggacctggggaccctgcgcggctactacaaccagagcgaggccgtgtctcacaccgtccagaggatgtatggctgcgacgtggggtcggacgggcgcttcctccgcgggtaccaccaggtagcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgacccaccacgctgtctctgaccatgaagccaccctgaggtgctgggccctgagcttctaccctgcggagatcacactgacctggcagcgggatggggaggaccagacccaggacacggagctcgtggagaccaggcctgcaggagatggaaccttccagaagtgggcggctgtggtggtgccttctggagaggagcagagatacacctgccatgtgcagcatgagggtctgcccaagcccctcaccctgagatgggagccgtcttcccagcccaccatccccatcgtgggcatcattgctggcctggttctccttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 3429 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 3430 - DNA, 2543 bp, Homo sapiens; identical to SEQ ID NO: 3417

SEQ ID NO: 3431 - DNA, 2930 bp, Homo sapiens
atggccgtcatggcgccccgaaccctcgtcctgctactctcgggggccctggccctgacccagacctgggcgggtgagtgcggggtcgggagggaaacggcctctgtggggagaagcaaggggcccgcccggcgggggcgcaggacccgggaagccgcgcctggaggagggtcgggcgggtctcagccactcctcgcccccaggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggtgagtgaccccggcccggggcgcaggtcacgacccctcatcccccacggacgggccaggtcgcccacagtctccgggtccgagatccgccccgaagccgcgggaccccgagacccttgccccgggagaggcccaggcgcctttacccggtttcattttcagtttaggccaaaaatccccccgggttggtcggggcggggcggggctcgggggaccgggctgacctcggggtccgggccaggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccctcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgagagacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgatgtggaggaggaagagctcaggtggggaaggggtgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcctggagggcctgatgtgtgttgggtgttgggcggaacagtggacacagctgtgctatggggtttctttccattggatgtattgagcatgcgatgggctgtttaaagtgtgacccctcactgtgacagatacgaatttgttcatgaatatttttttctatagtgtgagacagctgccttg

SEQ ID NO: 3432 - DNA, 1098 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctccccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtga

SEQ ID NO: 3433 - DNA, 1112 bp, Homo sapiens
cgagatgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagct

SEQ ID NO: 3434 - DNA, 1101 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccttccagaggatgtatggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagttggaggcggcccgtgcggcggagcaggacagagcctacctggagggcacgtgcgtggagtggctccgcagatacctggagaacgggaagaagacgctgcagcgcgcggaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctga

SEQ ID NO: 3435 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 3436 - DNA, 2081 bp, Homo sapiens
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaacctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttttttttttttttgttttttggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtga

SEQ ID NO: 3437 - DNA, 1568 bp, Homo sapiens
cagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcaaaaaaaaaaaa

SEQ ID NO: 3438 - DNA, 2587 bp, Homo sapiens
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 3439 - DNA, 1221 bp, Homo sapiens
agaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaaaaaaaaaaaaaaa

SEQ ID NO: 3440 - DNA, 1490 bp, Homo sapiens
ttggtgctcccagcacctagcaccgggagactggagaggtttccaggagagtgacccgagtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtc

SEQ ID NO: 3441 - DNA, 1490 bp, Homo sapiens; identical to SEQ ID NO: 3440

SEQ ID NO: 3442 - DNA, 1192 bp, Homo sapiens
cggcgactgaccgtggtcgtgggcggacggcggcttgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcag

SEQ ID NO: 3443 - DNA, 1490 bp, Homo sapiens; identical to SEQ ID NO: 3440

SEQ ID NO: 3444 - DNA, 1534 bp, Homo sapiens
cctgacacgccctcaaggcccgcggagctgctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagagctgaaggctgcttagaccagtgatttggaagcacagatttcatggctccctttgtgagaagtgtgtgctccagggtccggcagagcaggtggaatctgcagtttgaagagtcacattcacttttataacgtagtcttatatttgtttgtggtttgttttcatgataaaattgtgatttgttttatgataaaagaaactatagatatttaagcatgacaagatgttattagctggtaagcatatacaaaaagttgctttttgccaggtgtggtgactcacgcctataaatcccaggaccttgggaggctcaggctggaggattgcttgtggctagaatttcgagaccagcctgggcagcagagtgagacctctagaaagaagtaaaagtagctgagcatgatagtatgtgtctgtggtctcagctattcaggaagctaaggtcagaggattgcctgcgcccaggaatttgaggctgcagtgagccat

SEQ ID NO: 3445 - DNA, 1490 bp, Homo sapiens; identical to SEQ ID NO: 3440

SEQ ID NO: 3446 - DNA, 1490 bp, Homo sapiens; identical to SEQ ID NO: 3440

SEQ ID NO: 3447 - DNA, 1490 bp, Homo sapiens; identical to SEQ ID NO: 3440

SEQ ID NO: 3448 - DNA, 2524 bp, Homo sapiens
cgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaactcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 3449 - DNA, 2691 bp, Homo sapiens
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 3450 - DNA, 2524 bp, Homo sapiens; identical to SEQ ID NO: 3448

SEQ ID NO: 3451 - DNA, 2524 bp, Homo sapiens; identical to SEQ ID NO: 3448

SEQ ID NO: 3452 - DNA, 1109 bp, Homo sapiens
atgtccgccttttctttggctttggctttggtgagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 3453 - DNA, 1354 bp, Homo sapiens
ctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaa

SEQ ID NO: 3454 - DNA, 1677 bp, Homo sapiens
ggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggtgggacagggcgaggggctgggtcctgtcatccaggaggccagagattgggctgggccctcttgaccaggcagaaggggctgttttctggctccctgcagagaaagaggggtgtgtttgtgttccatggagcacttggtcatattggaggctggaatggagaagggtatggaaatgaacagtagaaataattaggaagccaggcctgctgacttagcgatagaggcggaaccctggtatctaggacactgcggaggctgacacattcccattctccttcccaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 3455 - DNA, 1109 bp, Homo sapiens; identical to SEQ ID NO: 3452

SEQ ID NO: 3456 - DNA, 1109 bp, Homo sapiens; identical to SEQ ID NO: 3452

SEQ ID NO: 3457 - DNA, 5585 bp, Homo sapiens
tgttgcatgaaactccggcgcaggagtcccgggctgccgctggcaacatcgtgtcacccagctaagaaagtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaat

SEQ ID NO: 3458 - DNA, 5585 bp, Homo sapiens; identical to SEQ ID NO: 3457

SEQ ID NO: 3459 - DNA, 3300 bp, Homo sapiens
atgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagaaaaaaaaaaaaaaaaaaaaa

SEQ ID NO: 3460 - DNA, 2391 bp, Homo sapiens
cgcaaccggaactagccttctgggggccggcttggtttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatctgtcttcaacactataaagcatttgtattgtgatttgattaagtatatatttggttgttctcaatgaagagcaaatttaaatattatgtgcatttgaa

SEQ ID NO: 3461 - DNA, 3345 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcgg

SEQ ID NO: 3462 - DNA, 2106 bp, Homo sapiens; identical to SEQ ID NO: 3297

SEQ ID NO: 3463 - DNA, 3613 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagaatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 3464 - DNA, 3613 bp, Homo sapiens; identical to SEQ ID NO: 3463

SEQ ID NO: 3465 - DNA, 3613 bp, Homo sapiens; identical to SEQ ID NO: 3463

SEQ ID NO: 3466 - DNA, 1885 bp, Homo sapiens
ctccttcgcgcagcggcgcgccaaccgcaggcgccctttctgccgacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagtactggaatcctttcagcaagacttctctttgcctcaaataaaaagtgcttttgtgagcttggttttgtgagctttggttttttaaaacaatagcaaccttctatctcacttcaaccatcactctccacatacccataaggcaggccagtcagtgatgcaaaaggagtgaggacttgacttttctacaagtcctcaactgcaagttgggggcccctcaccccagtactttacccatttagctttagggttgtgggtctcatcctggctgcacaccaggtcacctttgggggctttaaggctggtgatgtctggacctcgccctggaggctgatctgattgggctgtgatcaggacagcaggagtgtacaggctctccaggtgattccagggtgcagccaaggctgagccacagctttagggtaaacccatgttcgattccacagattccttggttgctccttctacgtatgaaggccgaggtcggtgtttactaagcagcacaacctga

SEQ ID NO: 3467 - DNA, 1331 bp, Homo sapiens
aattcgggcatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtg

SEQ ID NO: 3468 - DNA, 1448 bp, Homo sapiens
ctccttcgcgcagcggcgcgccaaccgcaggcgccctttctgccgacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgag

SEQ ID NO: 3469 - DNA, 2207 bp, Homo sapiens
ttggacctagcttggcgcggaatccgtgaattgcccgcggcccgagggtgcaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggtgagaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 3470 - DNA, 1750 bp, Homo sapiens
tggggagggggtgtggtcagggcggggcatgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 3471 - DNA, 1926 bp, Homo sapiens
gactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 3472 - DNA, 1582 bp, Homo sapiens
ccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacaaaaaaaaaaaaaaaaaaaaaaaaaa

SEQ ID NO: 3473 - DNA, 1750 bp, Homo sapiens; identical to SEQ ID NO: 3470

SEQ ID NO: 3474 - DNA, 2207 bp, Homo sapiens; identical to SEQ ID NO: 3469

SEQ ID NO: 3475 - DNA, 1464 bp, Homo sapiens
agtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacaactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggg

SEQ ID NO: 3476 - DNA, 2051 bp, Homo sapiens
agcgcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcc

SEQ ID NO: 3477 - DNA, 1529 bp, Homo sapiens
ggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcggctgagaaggcctaccatgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtataaaaccaagac

SEQ ID NO: 3478 - DNA, 1629 bp, Homo sapiens
cttacctcgactcttagttgtcgggaacggtaaccgggacccggtgtctgcttctatcaccctcgccttctaacccgtagctatcatgcgtgagtgcatctccatccacgtcggccaggctggtgtccagatcggcaatgcctgctgggagctctactgcctggaacatggcatccagcctgatggccagatgccaagcgacaagaccattgggggaggagatgactccttcaacaccttcttcagtgagacaggagctggcaagcacgtgccccgggcggtgttcgtagacctggaacccacagttattgatgaagttcgcactggcacctaccgccagctcttccacccagagcagctcatcacaggcaaggaagatgctgccaataactatgcccgtggccactacaccattggcaaggagatcattgaccttgtcttggacagaattcgcaagctggctgaccagtgcacgggtctccagggcttcttggttttccacagctttggtgggggaactggctctgggttcacctccctgctgatggagaggctctctgtcgactacggaaagaagtccaagctggagttctccatttacccagccccccaggtttccactgctgtggttgagccctacaattccatcctcaccacccacaccaccctggagcactctgattgtgccttcatggtagacaatgaggccatctatgacatctgtcgtagaaacctcgacattgagcgcccaacctacactaaccttaaccgccttattagccagattgtgtcttccatcactgcttccctcagatttgatggggccctgaatgttgatctgacagaattccagaccaacctggtgccctaccctcgcatccacttccctctggccacttatgcccctgtcatctctgctgagaaagcctaccatgaacagctttctgtagcagagatcaccaatgcctgctttgagccagccaaccagatggtgaaatgtgaccctcgccatggtaaatacatggcttgctgcctgctgtaccgtggtgatgtggtccccaaagatgtcaatgctgccattgccaccatcaagaccaagcgcagcatccagtttgtggactggtgccccactggcttcaaggttggcattaattaccagcctcccactgtggtacctggtggcgacctggccaaggtccagagagctgtgtgtatgctgagcaacaccacagccattgctgaggcttgggctcgcctggatcacaagtttgatctgatgtatgccaagcgtgcctttgtgcactggtatgtgggtgagggcatggaggagggagagttctctgaagcccgtgaggacatggctgccctagagaaggattatgaggaggttggtgtggattctgtggagggtgagggtgaggaagaaggagaggaatactagttcattcctgcagtccctgtatcatgtcaaactcaactccagctccagcactagctgcaggcatcgatgcttctatgctgtttcccttctgtgatcatgtcttctccatgtgtacctcttaagtttcccatgacgtctcaaagtaaaagctttaagaaaagaaaaaaaaaaaaaaaaaaaaaaaaaaa

SEQ ID NO: 3479 - DNA, 1513 bp, Homo sapiens
tgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaagac

SEQ ID NO: 3480 - DNA, 1418 bp, Homo sapiens
tgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaagacc

SEQ ID NO: 3481 - DNA, 1639 bp, Homo sapiens
cgccggccccgccctagtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaaatccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatca

SEQ ID NO: 3482 - DNA, 2029 bp, Homo sapiens
ctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctccctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatg

SEQ ID NO: 3483 - DNA, 1842 bp, Homo sapiens
ccgactgcttctgcacggtctctttgtctaaaggatgcaaacagtctacggatgctagagaaaaaggggtgggggagagattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctccctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatg

SEQ ID NO: 3484 - DNA, 1442 bp, Homo sapiens
ctacgtgagacgtacagcccaaactcatcatgcgcgagtgcatttcagtccatgtggggcaggcaggtgtccagatgggcaatgcctgctgggagctctactgtctggaacatgggattcagcctgatgggcagatgcccagcgataagaccattggtggaggggacgactccttcaccaccttcttctgtgaaactggagctggaaaacatgtgcctcgggcagtctttgtggacctggagcctactgtaatcgatgagatccgaaatggcccataccgtcagctcttccacccagagcagcttatcactgggaaagaagatgcagccaacaactatgcccgtggtcattacaccattggcaaggagatcatcgacccagtgctggaccggatccgcaagctgtctgatcagtgcacaggacttcagggcttcctagtattccacagctttggagggggcaccggctctggcttcacctctctgctgatggagcggctttctgttgactatggcaaaaagtccaagctggaattctccatctacccagccccccaagtgtccacggctgtagtggagccctacaactccatcctgaccacccataccaccctggaacactcagactgtgccttcatggtggacaacgaagccatttatgatatctgccgccgtaacctagatattgagcgtccaacctataccaacctcaaccgcctcatcagccaaattgtctcctccatcacagcttccttgcgctttgatggggccctcaatgtggacctgacagagttccagaccaacctggtgccctaccctcgcatccacttccccttggctacctatgcaccagtcatttctgcagagaaggcctaccatgagcagctgtcagtggcagagatcaccaatgcctgttttgagcctgccaaccagatggtgaaatgtgaccctcggcacggcaagtacatggcctgctgcctgctgtaccgtggagatgtggtgcccaaagatgtgaatgctgccatagctgccatcaagacgaagcgcagcatccagtttgtggactggtgccccacaggcttcaaggttggcatcaactaccaaccacccactgtggtgcctgggggtgacctggccaaggtgcagcgtgctgtgtgcatgctgagcaacacaaccgccattgctgaagcctgggcccgtctggaccacaagtttgacttgatgtatgccaagagggcttttgtacactggtatgtgggtgagggaatggaggagggggagttctctgaggctcgagaggatatggctgccctagaaaaagattatgaggaagtaggcatcgactcctatgaggacgaggatgagggagaagagtagaccgctacttggagcctgttcactgtgtttattgcaaaatcctttcgaaataaacagtctccttgc

SEQ ID NO: 3485 - DNA, 2029 bp, Homo sapiens; identical to SEQ ID NO: 3482

SEQ ID NO: 3486 - DNA, 2029 bp, Homo sapiens; identical to SEQ ID NO: 3482

SEQ ID NO: 3487 - DNA, 1424 bp, Homo sapiens
ctcgtaggatcggctgaggtactctgctaggagttcagcatgcgtgagtgtatctctatccacgtggggcaggcaggtgtccagattggcaatgcctgctgggagctgtactgccttgaacatggtattcagcctgacggtcagatgccaagcgacaaaaccattggcggcggggacgactcattcaacacattcttcagtgagactggagccggcaagcacgtgcccagggcagtgtttgtggacctggagcccactgtggtcgatgaagtacgcaccggaacctaccggcagcttttccacccagagcagctcatcactgggaaggaagatgcagccaacaattatgccagaggtcattataccattggcaaggagattgttgacctggtcctggaccggatccgaaaactggccgatctgtgcacgggactgcagggcttcctcatcttccacagctttggaggtggcacagggtctgggtttgcatcgctgctgatggagcggctttcagtggactatggcaagaagtccaagctggagtttgccatctacccagccccccaggtttctacagcggtcgtggagccttacaactccatcctgaccacgcacaccaccctggagcattccgactgtgctttcatggtggataacgaagccatctacgacatctgccggcgcaacctggatattgaacgtcccacatacaccaacctcaaccgtctgattgggcagattgtgtcatccatcacagcctccctaaggttcgatggcgccctgaatgtggacttaacagaattccagaccaacctggtgccataccctcgcatccacttcccactggcgacctatgccccagtcatctctgctgagaaggcataccatgagcagctgtcagtagcagagatcaccaatgcttgcttcgagccagccaatcagatggtcaagtgtgaccctcgccatggcaaatacatggcctgctgcatgttgtaccggggggatgtggttcccaaagatgtcaatgcggctattgccaccatcaagaccaagcgcaccatccagtttgtagattggtgcccgactggatttaaggtgggtattaactaccagcctcctactgtggtccctgggggagacctggccaaggtgcagcgggctgtgtgcatgctgagcaataccacggccatcgcagaggcctgggcccgcctggaccacaaatttgacctcatgtacgccaagcgggcctttgtgcattggtacgtgggagaaggcatggaggaaggggagttctccgaggcccgggaggacctggcagcgctggagaaggactatgaagaggtgggcgtggattccgtggaagcagaggcagaagaaggggaggagtactgagcgcatgggtctggctggcggccgtccattta

SEQ ID NO: 3488 - DNA, 1639 bp, Homo sapiens; identical to SEQ ID NO: 3481

SEQ ID NO: 3489 - DNA, 2051 bp, Homo sapiens; identical to SEQ ID NO: 3476

SEQ ID NO: 3490 - DNA, 1346 bp, Homo sapiens
gttcctgttcacagcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcggctgagaaggcctaccatgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtat

SEQ ID NO: 3491 - DNA, 1730 bp, Homo sapiens
gcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccg

SEQ ID NO: 3492 - DNA, 1730 bp, Homo sapiens
gcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccg

SEQ ID NO: 3493 - DNA, 1481 bp, Homo sapiens
ggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcaccccctcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctct

SEQ ID NO: 3494 - DNA, 1385 bp, Homo sapiens
cgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3495 - DNA, 2143 bp, Homo sapiens
agcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3496 - DNA, 1214 bp, Homo sapiens
cgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttcccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgac

SEQ ID NO: 3497 - DNA, 1490 bp, Homo sapiens
cggcggttggaggttgtacgcggattccggcgaggaataggaatcatggcggctgcgctgttcgtgctgctgggattcgcgctgctgggcacccacggagcctccggggctgctggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgatcccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcaacttgcccacaccgagggcgaccccgtcacagcctcaagtcactcccaagccccctccttgtctgtgcatccgggggcagctctggagggggtttgctggggaactggcgccatcgccgggactccagaaccgccg

SEQ ID NO: 3498 - DNA, 1214 bp, Homo sapiens; identical to SEQ ID NO: 3496

SEQ ID NO: 3499 - DNA, 6646 bp, Homo sapiens
cggcccaaaaggccagtcttagtcctatcaggaaccccttccgccacccccacacccccactggcccaacagcattgggtttatttccaggcagctggtgagcagggttgagaacttgccccaggtgacaagtctcccagctgagaacgcaagctgatctccagttcctcggctctcccatgcagcatgcagcagcattccacctccttcaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagaaccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccgtcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacac

SEQ ID NO: 3500 - DNA, 12889 bp, Homo sapiens
agttgtggagtcgtttttcctcggagcagggaagcgggcagcagcagccggccgcgggctttctcccgccgaggggcgaggaggagcctctggctccagaagccgattggggaatcacggggagcggcgccccccttcttttgggtcatttctgcaaacggaaaactctgtagcgtttggcaaagttggtgcctgcgcgccccttccaggtttgcgctttgactgttttgtttttggcggaactaccaggcaggaagattgcacaagtaaggggcgttttcagtcgggtgtcaatttctctttctttctttctttttttaaaatttcggttcgtgtctgcttctccaagctttatttttttttttaaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagaaccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccgtcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacac

SEQ ID NO: 3501 - DNA, 12933 bp, Homo sapiens
agttgtggagtcgtttttcctcggagcagggaagcgggcagcagcagccggccgcgggctttctcccgccgaggggcgaggaggagcctctggctccagaagccgattggggaatcacggggagcggcgccccccttcttttgggtcatttctgcaaacggaaaactctgtagcgtttggcaaagttggtgcctgcgcgccccttccaggtttgcgctttgactgttttgtttttggcggaactaccaggcaggaagattgcacaagtaaggggcgttttcagtcgggtgtcaatttctctttctttctttctttttttaaaatttcggttcgtgtctgcttctccaagctttatttttttttttaaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagaaccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggtaaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccgtcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacac

SEQ ID NO: 3502 - DNA, 10302 bp, Homo sapiens
atggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcggcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagcgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcggggccgacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtga

SEQ ID NO: 3503 - DNA, 12357 bp, Homo sapiens
cagatgtaggtgatgagcggcctggcagccaccacgtttcattggaaaaagtgcagattggatttgccagggcatgtagctctccaggcttgcaagcgaatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagaaccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccgtcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacac

SEQ ID NO: 3504 - DNA, 3874 bp, Homo sapiens
gggacaagctgcttctgataggagccaggctggcagtggcagggctggagggtcctggcctgggatggggaggggactgcccaaggttggggtgggtcaaggctgctggcctgggagactggtgatttcctggtaactggacccgtggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacatcatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgccctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggatctattttttgggcttttaatattctgttccattgacctatttctcttttcttttaccaataccgcaacatcttggttactgtagcttcacggtaagtcttaaaacttggatattgtcagtcctccaactatgttctactccttcaatattgtgttggttattctgagtcttttgtctctccatataaattgtagaattagattgctgatatccataaaaaaactttctggagggccccagggagcgcggggcgccgctgctgctgctgctgctcctcggctgggttgtgtctactgggcccgcggctgcggcggcagaggggcctgagccgggagccgcgctcagccgagagttgggcagagggagtgcccgcgccgccgcggcgtcatgggccccctcccctcacctcagcgggcaccagccgcgggaacccccgggcctcctcgcgcccgagcctgagcgacccctgggttctccggcgccccctccctccccctatttttcttttcctgctcttgct

SEQ ID NO: 3505 - DNA, 1689 bp, Homo sapiens
gaggcaaagacctcctagcagagggggagaggagggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacatcatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcaaccaagagaacatcaaggagaggtcacctctggcttttattcccttctcggcagggcccagaaactgcatcgggcaggcgttcgccatggctgagatgaaggtggtcctggcgctcacgctgctgcacttccgcatcctgccgacccacactgaaccccgcaggaaacccgagctgatattgcgcgcagagggtggactttggctgcgggtggagcccctgggtgcgaactcacagtgactgccctacccacccacccacctctgtagagtcccagaaacaaaactatgctgacaaaaaaaaaaaaaaaaaaaaaaa

SEQ ID NO: 3506 - DNA, 3874 bp, Homo sapiens; identical to SEQ ID NO: 3504

SEQ ID NO: 3507 - DNA, 3742 bp, Homo sapiens
taagatattatttgagtcttagtatagttaggtcttagggtagatttgaattatgccgaagaataggcttggttatacccgggccatgtttaggacattagtgacatcatatttaaatgttatctaggacccttcactgggatacacagaagtcatatcagaccatctcaggtccatggcagagcatgttgtgtcatttagggtttgtcatatgtgttttggccatgtcagggaatgttaacaactgtcggggcaatattccaggtcccagatccatgtcagaagatagcagagagtgctgggagtagacagagtgtcctaggtccctgtaaaggcattctgtagagtgttgagctatgctcaggtgttgcagaacatgttggaccatgtaggagatatgtcactgtgtgctggggcatgctgtgttattgctctactctgtcgctgcagcctggtctggtctctccttcctccaccatcctcccttcttcctctacccttggccttcttcctgctatgctgggtgggatgagtggaagtgcacacccctggctgggagcattcctccatacccaaagtccttctcttacccctctccatggccactgatggtcctcaatcatgtcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgccctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggatctattttttgggcttttaatattctgttccattgacctatttctcttttcttttaccaataccgcaacatcttggttactgtagcttcacggtaagtcttaaaacttggatattgtcagtcctccaactatgttctactccttcaatattgtgttggttattctgagtcttttgtctctccatataaattgtagaattagattgctgatatccataaaaaaactttctggagggccccagggagcgcggggcgccgctgctgctgctgctgctcctcggctgggttgtgtctactgggcccgcggctgcggcggcagaggggcctgagccgggagccgcgctcagccgagagttgggcagagggagtgcccgcgccgccgcggcgtcatgggccccctcccctcacctcagcgggcaccagccgcgggaacccccgggcctcctcgcgcccgagcctgagcgacccctgggttctccggcgccccctccctccccctatttttcttttcctgctcttgct

SEQ ID NO: 3508 - DNA, 3044 bp, Homo sapiens
atctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttgga

SEQ ID NO: 3509 - DNA, 1757 bp, Homo sapiens
aactgcgaagcccccctctctctccccgttgctcttggaaactctaaggctcagaaaagggggcgctagcctcatattcatgtagggtcgctcgcgggaggcggggtcaagctgctgtctccacctggagcgccgggagtccgggcgggggcggtgctgtggaatgtccccgactacaacccccggtcgggattccaggctaatcaatagttgcttcgattcagaaatgcaaaaccctaacctcactcaaaaatttcaggccaagggatccagataataccagatgggtcttaagaaagccgttttgctgtgggataaagagccgcttagtcggggatcgttttcgggtcattttactgagcgccgcctcgccgggctcagagcggttcctgggaaattggaccaatgggctcgcgctgcgcgctgcggtgccgcccaggacctgggcctacatttccctacatgcactgcagctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatggga

SEQ ID NO: 3510 - DNA, 501 bp, Homo sapiens
atggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgcggtcatctccctggagggcaagcctttgtga

SEQ ID NO: 3511 - DNA, 1432 bp, Homo sapiens
cgcccctgcggggctggactgttctctccagatggtgagtccggggcatggtcacctgcgggagagaaaagagttaactccacactccacgaatccggcagctgcgaggatctgggatgcaacctactcagatggttacgtgagaccgctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatggga

SEQ ID NO: 3512 - DNA, 1757 bp, Homo sapiens; identical to SEQ ID NO: 3509

SEQ ID NO: 3513 - DNA, 1432 bp, Homo sapiens; identical to SEQ ID NO: 3511

SEQ ID NO: 3514 - DNA, 1432 bp, Homo sapiens; identical to SEQ ID NO: 3511

SEQ ID NO: 3515 - DNA, 1179 bp, Homo sapiens
gccccgcccctcattgtgcggctcctactaaacggaaggggccgggagaggccgcgttcagtcggatcccggcggcagctgcagcggctctcatctcttctgaccctttttgctatctccctttcgcttccggaaacatggcctctggcgtggcggtttctgatggcgtcatcaaagtgttcaatgacatgaaggtgcgtaagtcttcaacacccgaggaagtgaagaagcgcaagaaggcagttcttttctgcctgagcgaggacaagaagaacatcatcctcgaggagggcaaggagatcctggtaggtgatgtgggccagactgtagatgacccctacgccacctttgtcaagatgctaccagacaaggactgccgctatgccctctatgacgcaacctatgagaccaaggagagcaagaaggaggacctggtgtttatcttctgggcacctgagtctgcaccccttaagagcaaaatgatttatgccagctccaaggatgccatcaagaaaaagctgactgggatcaagcatgagttacaagcaaactgctacgaggaggtcaaggaccgctgcaccctggcagagaaactggggggcagtgccgtcatctctctggagggcaagcctttgtgagccccctccagccccctgcctggagcatctggcagccccagacctgcccatgggggttgcaggctgcccccttcctgccagaccggaggggctggggggatcccagcagggggagggcaatcccttcaccccagttgccaaacagccccctcaccccctggaccttcctcctccctctatccctgacggttctggctttcccaaaccgcttttgatcttctgattcctcttgggttgaagcagaccaagttccccccaggcaccccagtttggggggggcctgtattttttttaacgacaccccagttcctcacctgttcctcccttttcccatgctgccaacttctaaccgcaatagtgactctgtgcttgtctgtttagttctgtgtataaatggaatgttgtggagatgacccttccttgcgccacctggttcccctccccttttcccctggtcttggcactcatggaaacaggaccagtaagggaccttcaattaaaaaaaaaccaacaacacacacaacaataaaaaggctcacta

SEQ ID NO: 3516 - DNA, 1313 bp, Homo sapiens
caggacgtgagacttctacctgctcactcagaatcatttccgcaccaaccatggccacgtttgtggagctcagtacaaaagccaagatgcccattgtgggcctgggcacttggaggtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaaagataaataataaaaaataat

SEQ ID NO: 3517 - DNA, 1764 bp, Homo sapiens
actttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaccaaca

SEQ ID NO: 3518 - DNA, 951 bp, Homo sapiens
atggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcgatgcagaatattag

SEQ ID NO: 3519 - DNA, 1313 bp, Homo sapiens; identical to SEQ ID NO: 3516

SEQ ID NO: 3520 - DNA, 1574 bp, Homo sapiens
gacgttccagggctccacaggccactgtcttctggaggggaacggatcgactgccggtgcgcccagccaaattcaactcctgagtcctcagtctctagtcccgggaaggtttcaccgagctgccctactccttgtaccccttctagctggccttagcatagctacgtcagcagctattggcacgactgccctgattcaaggagaaactggactaatatcactatctcaacaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcatctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgagg

SEQ ID NO: 3521 - DNA, 1047 bp, Homo sapiens
tatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaaagataaataataaaaaataat

SEQ ID NO: 3522 - DNA, 2642 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcggcctggggaacttgcggtcctgggttcctgctgagtgtactgattctgtgataagaataactaggttcttgtggttttggcgagtagtacttaccaatgagagttgggtagtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggcgtcattgttggtgcaggttacattgctgtggagatggcagggatcctgtcagccctgggttctaagacatcactgatgatacggcatgataaggtaaatatgcaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccggaggccgaggcaggaggattacttgagcctacaagtttgaggccagcatgcacagcatagcaagactgcatctctacagagagtaaaaaaaattacccgagtgtggtgatgtgcatctgtaatctcagctacttggga

SEQ ID NO: 3523 - DNA, 3131 bp, Homo sapiens
tgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaatatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaattt

SEQ ID NO: 3524 - DNA, 3137 bp, Homo sapiens
tgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggcgtcattgttggtgcaggttacattgctgtggagatggcagggatcctgtcagccctgggttctaagacatcactgatgatacggcatgataaggtaaatatgcaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaatatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaattt

SEQ ID NO: 3525 - DNA, 1643 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgactt

SEQ ID NO: 3526 - DNA, 3131 bp, Homo sapiens; identical to SEQ ID NO: 3523

SEQ ID NO: 3527 - DNA, 2985 bp, Homo sapiens
agagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagaaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaatcgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 3528 - DNA, 2920 bp, Homo sapiens
cgcctgcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagaaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaatcgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 3529 - DNA, 1964 bp, Homo sapiens; identical to SEQ ID NO: 3319

SEQ ID NO: 3530 - DNA, 14773 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttaaaaaaaaaa

SEQ ID NO: 3531 - DNA, 14612 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 3532 - DNA, 14614 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggagaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 3533 - DNA, 14574 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggcagaggttgcagtgagttgagatcacgccactgcactccagcctgggcgacaagagtgaaactgtctcaaaaaacaaaaactgttacagtttatagagacatcctacatgtgtttcaaattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 3534 - DNA, 5757 bp, Homo sapiens
cggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagaggtgagagcttaggccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaat

SEQ ID NO: 3535 - DNA, 2045 bp, Homo sapiens
accggaagcgtgcggttgccatgtaatatcctggccgcgcgggcgcgcgagcggctgaggcggcgccggggcgggcgcggagctggcaagcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagccgaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccag

SEQ ID NO: 3536 - DNA, 2179 bp, Homo sapiens
accggaagcgtgcggttgccatgtaatatcctggccgcgcgggcgcgcgagcggctgaggcggcgccggggcgggcgcggagctggcaagcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagccgaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacagcccc

SEQ ID NO: 3537 - DNA, 2045 bp, Homo sapiens; identical to SEQ ID NO: 3535

SEQ ID NO: 3538 - DNA, 2045 bp, Homo sapiens; identical to SEQ ID NO: 3535

SEQ ID NO: 3539 - DNA, 1110 bp, Homo sapiens
agcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccgtggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtga

SEQ ID NO: 3540 - DNA, 2557 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagagggg

SEQ ID NO: 3541 - DNA, 3715 bp, Homo sapiens
tttcattttttcaagtggaaccatggaggagagtggctgcccaaggtggggtttgtcttttgctgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcggaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttgctctttgc

SEQ ID NO: 3542 - DNA, 3715 bp, Homo sapiens; identical to SEQ ID NO: 3541

SEQ ID NO: 3543 - DNA, 550 bp, Homo sapiens
tgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaacca

SEQ ID NO: 3544 - DNA, 408 bp, Homo sapiens
atggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactag

SEQ ID NO: 3545 - DNA, 6252 bp, Homo sapiens
agtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggcaagggtttctgatctcattaaggagtgcaggcagtctcttgcagaaagcctttttgcctgggcttgccagtcacctttaggcaaagaagacactctcctcctcattggacatttggaaagagtgacagttgaggctaatggttcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcactctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaac

SEQ ID NO: 3546 - DNA, 6252 bp, Homo sapiens; identical to SEQ ID NO: 3545

SEQ ID NO: 3547 - DNA, 2439 bp, Homo sapiens
gaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctattt

SEQ ID NO: 3548 - DNA, 2589 bp, Homo sapiens
cgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 3549 - DNA, 2550 bp, Homo sapiens
ggtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaaaaaaaaaaaaaa

SEQ ID NO: 3550 - DNA, 2589 bp, Homo sapiens; identical to SEQ ID NO: 3548

SEQ ID NO: 3551 - DNA, 2589 bp, Homo sapiens; identical to SEQ ID NO: 3548

SEQ ID NO: 3552 - DNA, 1575 bp, Homo sapiens; identical to SEQ ID NO: 3294

SEQ ID NO: 3553 - DNA, 2366 bp, Homo sapiens; identical to SEQ ID NO: 3090

SEQ ID NO: 3554 - DNA, 1136 bp, Homo sapiens
gaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaatttgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatt

SEQ ID NO: 3555 - DNA, 2106 bp, Homo sapiens; identical to SEQ ID NO: 3297

SEQ ID NO: 3556 - DNA, 3188 bp, Homo sapiens
gcagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggcccaggtggtggagacagagacaggcccctgaacgataagcaccaagagaccccaaggctccagatggaacactgagggtgaccgtccctctcagaagccttttccctggaagtgtccatgcctcacctgcaacccatgtggttctcagacttgaatcttctcggccccccaaaaagaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccctaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctgtcacatagtaggagcttctagatgcatgtggaagcaatgagagttgtcccttagccttataaactccccatgatctgacatgcagaaatccagccttgtccagaatcctcctggaatttcttggagacgaaagtatctgggggattgttgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggggcggttctcgaggtgtgtgccagctacacgtgtgttctgtatgggtccagctgcgtttccatcactcgctaataaatcaacagaaacac

SEQ ID NO: 3557 - DNA, 2216 bp, Homo sapiens
ccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaa

SEQ ID NO: 3558 - DNA, 766 bp, Homo sapiens
ctctttctgctgctccccagctctcggatacagccgacaccatgggtttcagagacctgaaaagccccaccggcctccaggtgctcaacgattacctggcggacaagagctacatcaaggggtatgtgccatcacaagcagatgtggcagtatttgaagccgtgtccggcccaccacctgccgacttgtgtcatgccctacgttggtataatcacatcaagtcttacgaaaaggaaaaggccggcctgccaggagtgaagaaagctttgagcaagtatggtcctgccgatgtggaagacactacaggaagtggagctacagacagtaaagatgatgatgacattgatctctttggatccgattatgaggaggaaagtgaagaagcaaagaggctaagggaagaacatcttgcacaatatgaatcaaagaaagccaaaaaacctgcacttgttgccaagtcttccatcttactagatgtgaaaccttgggatgatgagacagatatggcgaaattagaggagtgtgtcagaagcattcaagcagacggcttagtctggggctcatctaaactagttccagtgggatacggaattaagaaacttcaaatacagtgtgtagttgaagatgataaagttggaacagatatgctggaggagcagatcactgcgtttgaggactatgtgcagtccatggatgtggctgctttcaacaagatctaaaatccatcctggatcatggcatttaaataaaagcttgaaagattaaa

SEQ ID NO: 3559 - DNA, 2084 bp, Homo sapiens
cttcccgcgtccgccgattcctcctccttggtcgccgcgtccttggctggcctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccg

SEQ ID NO: 3560 - DNA, 2084 bp, Homo sapiens; identical to SEQ ID NO: 3559

SEQ ID NO: 3561 - DNA, 789 bp, Homo sapiens
ctctttctgctgctccccagctctcggatacagccgacaccatgggtttcagagacctgaaaagccccaccggcctccaggtgctcaacgattacctggcggacaagagctacatcaaggggtatgtgccatcacaagcagatgtggcagtatttgaagccgtgtccggcccaccacctgccgacttgtgtcatgccctacgttggtataatcacatcaagtcttacgaaaaggaaaaggccggcctgccaggagtgaagaaagctttgagcaagtatggtcctgccgatgtggaagacactacaggaagtggagctacagacagtaaagatgatgatgacattgatctctttggatccgattatgaggaggaaagtgaagaagcaaagaggctaagggaagaacatcttgcacaatatgaatcaaagaaagccaaaaaacctgcacttgttgccaagtcttccatcttactagatgtgaaaccttgggatgatgagacagatatggcgaaattagaggagtgtgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaaatccatcctggatcatggcatttaaataaaagcttgaaagattaaagaaaaaagaaagaaagaaagaa

SEQ ID NO: 3562 - DNA, 787 bp, Homo sapiens
gtgggctctttctgctgctccccagctctcggatacagccgacaccatgggtttcagagacctgaaaagccccgccggcctccaggtgctcaacgattacctggcggacaagagctacatcgaggggtatgtgccatcacaagcagatgtggcagtatttgaagccgtgtccagcccactgcctgccgacttgtgtcatgccctacgttggtataatcacatcaagtcttacgaaaaggaaaaggccagcctgccaggagtgaagaaagctttgggcaagtatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagcgcgtcagaagcattcaagcagacggcttagtctggggctcatctaaactagttccagtgggatacggaattaagaaacttcaaatacagtgtgtagttgaagatgataaagtcggaacagatatgctggaggagcagatcactgcttttgaggactacgtgcagtccatggatgtggctgctttcaacaagatctaaaatccatcctggatcatggcatttaaataaaagcttgaaagattaaaaaaaaaaaaaaagaag

SEQ ID NO: 3563 - DNA, 2012 bp, Homo sapiens
cttcccgcgtccgccgattcctcctccttggtcgccgcgtccttggctggcctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccg

SEQ ID NO: 3564 - DNA, 2012 bp, Homo sapiens; identical to SEQ ID NO: 3563

SEQ ID NO: 3565 - DNA, 831 bp, Homo sapiens
agtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacc

SEQ ID NO: 3566 - DNA, 960 bp, Homo sapiens
atggatattgaatcatttcatatctacctacatgtaaatgtaggtagatatgaaatgtgtcccgcgtccgccgattcctcctccctggtcgtcgcgtccttggcaggcgtcagaaaaatggctacaaacttcctagtacatgagaagatctggttcgacaagttcaaatatgacgacgcagaaaggagattctacgagcagatgaatgggcctgtggccggtgcctcccgccaagagaacgacgccagcgtgatcctccgtgacatcgcgagagccagagagaacatccagaaatccctggccggaaactcaggccccggggcctccagcggccccagcggagaccacagcgagctcgtcgtccggatcaccagtctgaaagtggagaaccagagcctgcgcagtgtggtacaggagctgcagcaggtcatctccaagctggaggcccggctgaacgtgctggagaagaactcgcctggccaccgggccacggccccacagacccagcacatgtctcccatgcgccaagtggagcccctggccaagaagccattcacaccagcagaggatgacgacgatgatgacactgacctgtttggcagcgacaatgaggaggaggacaagaaggcggcacagctgcaggaggagcggctgcagcagtacgcggagaagaaggccaagaagcctgaactggtggccaagtcctccatcctgctggatttcaagccttgggacgatgagactgacatggcccagctggaggcctgtgtgtgctccatccagctggaagagctggtctagggggcctccaagctggtgcccatgggctacggtatccggaagctacagattcagtgtgtggtggaggacgacaaggtggggacagacttgctggaggagatcaccaagtttgaggagcacgtgcagagtgtcgatatcgcagctttcaacaagatctga

SEQ ID NO: 3567 - DNA, 2084 bp, Homo sapiens; identical to SEQ ID NO: 3559

SEQ ID NO: 3568 - DNA, 2012 bp, Homo sapiens; identical to SEQ ID NO: 3563

SEQ ID NO: 3569 - DNA, 1021 bp, Homo sapiens
tcatcaatcttcccgcgtccgccgattcctcctccttggtcgccgcgtccttggctggcgtcagaaaaatggctacaaacttcctagcacatgagaagatctggtttgacaagttcaaatatgacgacgcagaaaggagattctatcagcagatgaacaggcctgtggcaggtgcctcccgccaggagaacggcgccagcgtgatcctccatgacattgtgagagccagagagaacatccagaaatccctggctggaagctcaggccccggggcctccagtggccccagcggagaccacagcgagctcgttgtccggatcgccagtctggaagtggagaaccagagcctgcgtggcgtggtacaggagctgcagcaggccatctccaagctggaggcccagctgaacgtgctggagaagagctcgcctggccaccgggccacggccccgcagacccagcacgtgtctcctatgcgccaagtggagtccccggccaagaagccagcctcaccagcagaggatgacgaggatgatgacatcgacctgtttggcagcgacaatgaggaggaggacaaggaggcggcacagctgcgggaggagcggctacggcagtacgcggagaaggccaagaagcctgcattagtggccaagtcctccatcctgctggatgtcaagccttgggacgatgagacggacatggcccagctggaggcctgtgtgcgctctatcgagctggacgggctggtctgggggacctccaagctgatgcccgtgggctacggtatccggaagctacagattcagtgtgtggtggaggacgacaaggtggggacttacttgctggaggaggagatcactaaatttgaggagcacgtgcagagtgtcgatatcgcagctttcaacaagatctgaagcctgagtgtgtgtatgtgtgcgcgtgcgtaaggccctgccacgattaaagactgagaccggcaaaaaaaaaaaaaaaaaaaaaaaagaaaaaaaaaagaaagaaagaa

SEQ ID NO: 3570 - DNA, 1018 bp, Homo sapiens
gagccctttcatcaatcttcccgcgtccgccgattcctcctccttggtcgccgcgtccttggctggcgtcagaaaaatggctacaaacttcctagcacatgagaagatctggtttgacaagttcaaatatgacgacgcagaaaggagattctatcagcagatgaacaggcctgtggcaggtgcctcccgccaggagaacggcgccagcgtgatcctccatgacattgtgagagccagagagaacatccagaaatccctggctggaagctcaggccccggggcctccagtggccccagcggagaccacagcgagctcgttgtccggatcgccagtctggaagtggagaaccagagcctgcgtggcgtggtacaggagctgcagcaggccatctccaagctggaggcccagctgaacgtgctggagaagagctcgcctggccaccgggccacggccccgcagacccagcacgtgtctcctatgcgccaagtggagtccccggccaagaagccagcctcaccagcagaggatgacgaggatgatgacatcgacctgtttggcagcgacaatgaggaggaggacaaggaggcggcacagctgcgggaggagcggctacggcagtacgcggagaaggccaagaagcctgcattagtggccaagtcctccatcctgctggatgtcaagccttgggacgatgagacggacatggcccagctggaggcctgtgtgcgctctatcgagctggacgggctggtctgggggacctccaagctgatgcccgtgggctacggtatccggaagctacagattcagtgtgtggtggaggacgacaaggtggggacttacttgctggaggaggagatcactaaatttgaggagcacgtgcagagtgtcgatatcgcagctttcaacaagatctgaagcctgagtgtgtgtatgtgtgcgcgtgcgtaaggccctgccacgattaaagactgagaccggcaaaaaaaaaaaaaaaaaaaaaaaagaaaaaaaaaa

SEQ ID NO: 3571 - DNA, 2084 bp, Homo sapiens; identical to SEQ ID NO: 3559

SEQ ID NO: 3572 - DNA, 831 bp, Homo sapiens; identical to SEQ ID NO: 3565

SEQ ID NO: 3573 - DNA, 678 bp, Homo sapiens
atgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctag

SEQ ID NO: 3574 - DNA, 990 bp, Homo sapiens
cgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaaaaaaaaaaa

SEQ ID NO: 3575 - DNA, 2674 bp, Homo sapiens
cgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 3576 - DNA, 2490 bp, Homo sapiens
tcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 3577 - DNA, 2490 bp, Homo sapiens; identical to SEQ ID NO: 3576

SEQ ID NO: 3578 - DNA, 2490 bp, Homo sapiens; identical to SEQ ID NO: 3576

SEQ ID NO: 3579 - DNA, 3026 bp, Homo sapiens
gcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatg

SEQ ID NO: 3580 - DNA, 3020 bp, Homo sapiens
cggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccattaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgccagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatg

SEQ ID NO: 3581 - DNA, 778 bp, Homo sapiens
ttttttgaaaaaaaaaaaaacaaggaaagaaagattagctgggcatgatggtgcacacctgcagtcccagctacttgggaggctgaggcagcagaattgcttgaacctgggaggcagaggttgcagtgagccaagatcacactactgtaccccaggctgggagacagagtgagactccatctcaaaaataaaaccagaaataaaaaaagaaagaaatatttttaaaaagtcatactgctaagaataataggttttcatttagttcatcaatagaattccaatgaccttaaatgacaacattgcaaatattttccacgtaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagtaagaaatatttggtatacaatagagaaatgttctatcaaaaagtgactttgagatagaaataataaaagtacacattatttgactaacttttaggatgcacatttaattcttcacatttttgtgtctcccgagtcacagtgcatctgtggcatgatgtagtttaattggcagagtcttttcttcccacagtgtgtaaataatggtgtggcttacaaatgatgacatcttagatttataaaatatgttctttgatccctacggcacctatgtg

SEQ ID NO: 3582 - DNA, 2703 bp, Homo sapiens
cattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgccagcctgggcaacagagcaagactctgtctcaaaagaaag

SEQ ID NO: 3583 - DNA, 3020 bp, Homo sapiens; identical to SEQ ID NO: 3580

SEQ ID NO: 3584 - DNA, 913 bp, Homo sapiens
aggcggggcgcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtatgagcagataaacattaacagaattatcttgccttaatgatgaattctttgggtgatttaacaggatgtgagttttaaaactccattttcaggaaatacacagaaattccttatttttctattagtgatgggtatataattggaaataatattctcaaacagtaagaaacaacagaaacaggtatgaagtctttctggattgagttttgaaattaaaaaatcagtttggagccaatggggggagaaaaaacagccttcccttttacattttctggatccttgtatgtggttcagtttttgtaggtggtttaggaatttagctaagttaatttttagatatttgaaatggtggtggacagagaaattcaaaatgaattacagctttttggcaggacaatgttcatagtccacagttcagctcaaccttcccctcccaccagggaacacaggagtttctgttatcgtgaatcattgttataaaaccagtgattaagaaagtatttcttgtgagta

SEQ ID NO: 3585 - DNA, 8004 bp, Homo sapiens; identical to SEQ ID NO: 2882

SEQ ID NO: 3586 - DNA, 8000 bp, Homo sapiens; identical to SEQ ID NO: 2883

SEQ ID NO: 3587 - DNA, 7968 bp, Homo sapiens; identical to SEQ ID NO: 2880

SEQ ID NO: 3588 - DNA, 1782 bp, Homo sapiens
gactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaagcgggaggacgcggagcacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggagcaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 3589 - DNA, 4532 bp, Homo sapiens
ggatccagagctgggtccagccaccctcagccccctatgatgtacccacctcattggggcttgttgcggggtaggtctaggtttgggggctgtgtctttaaggctgaaacatcagcagacaacctctgctgggccgtcttcaggggagggggaggggggctggtcagcccattagcagcagagctggcgccaggcaccagcccttcacagggccctggggattagggagagtagctcttccccagcccgatctgcctctgcgcccctgtctcctattcctctctgggtgtggtgaaggaggggtagctgacagcaggtgaaaatagagcctggccttcagggggcaagtcaaggcactagctatggggcctaagccaggtcaactctccctccagctggcctcctccctactcctgtgccagaagcctgccctttaacttcaggtccttctacctcgcaattttcagggactctagttcaagtcaggccttcctaccctaggttctagctttgggtgcttgttgggaggaagtgacccccaccccagcggcaacagggggcaatcaagtgggtagaggcctgcaaccagggaagggaggggaaggcgctcctgctgttccgcaggggtggggcatccccctccccatacaacccccctccagcggccatcaggccagtgggaggagctgcccgtgccccccctgagaccgcagggctataaagcgcctcgcagcggtctgcggctccttcccagcccccggcctagctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgcgggccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggtcagggggcagggctgggccgctgccgtcgaggcgaggtcgaagcggcgtcgaggcggctgctcttgcctcccctcgcttcccctctccatcagcagcccaagggtgtggctccccttaccaacccaggtgtgtgcgggcagcatccctcgcccacgggctccaagtgccccccgctacccctttgctctgagtgtttggggaggtgggagaagtgggtatctgtgcctcccctgagtaatgaggaaacccccttttcagctcccagtccgttagagacaatgcggggcaattccattagacagcctcagccctccatttagagtcctgggcagcagaacagcctctaaccggatcctggggggcgtgcggtctggggtgcgagctgggcgcgaccccgcagttcagcctctgcacgctcttcccgtcaggttggaggaggagacgcgcaagcgggaggacgcggagcacaacctcgtgctcttccgcaaggtgagtccgagcccctctccgagttcagcctccccaccgctacccccgatctcagtatccagaggtggcatcggtgggcgcggggagaagggggtaacccagatgcctcctgaggcagacagggaaggcctggtccttccttggtctgcgcagcccctaacttatcttgaacctccactgccacccctcgaaggacgtggacgatgccactctgtcccgcctggaactagagcgcaagattgagtctctgatggatgagattgagttcctcaagaagctgcacgaggaggtaagtgggcccggtatcaggggcggtttctgaggttgtggggtggtctcgctggagctggcgggtggagcggaggcatcgccctggggatcaggacgatgctgggtagacgcagcccctccaccctagtctacaggtggttagactcccacccttgcgccacctggcggcgggcagcggggctgtacctccgaaacctggcctctggtctcgcgcccgcgggggcagctgtacgccctgccctccctggcgcccacttctgttcgttcaagcgtttcttctcttttctgtgcacgaactgcgtggcccgcgtggaatttgcgccgctgtccatcctctgcctgctcccggccgtaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaaggtgcaagagccgggagggcctgcgaggcgggacgctggggtggtgtcgcgcgtcccagccgactaaagcctgggttacccccacttctcagtacgcggacctgtccgacgctgccaaccggaaccacgaggccctgcgccaggccaagcaggagatgaacgagtcccgacgccagatccagagtctaacgtgcgaggtggacgggctgcgcggcacggtgagtacgaagctgcgcgctcgggcccggggagcggacgatgaaatgttctgcaactggccccttccactctcctaccccagaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggtgagggtggagctgctggggcggggcagggcggggtcgggactgggccgggcagggcggggcctgggcaggggcgctgacaacttgcttcgcctctaggatctccgtgcccgtccattcttttgcctccttaaatataaagacgactggtgagtctgccttacagcctgtacctctccttgtccacttctgccctcctcgggctcttgctctggctcacctcagggatctcttctccccacggaacttctgggtcctggcctgtacccacccctactcctcaaacccgcccctcccctgccctcagggatagcagtgggagcctaagaggagagattcccacgccttcccccttgaaccctttatcctgctttcttcagtgcctgaggtggagcctccccaggacagccacagccggaagacggttctgatcaagaccattgagacccggaatggggaggtgaggcaggtcccctaatgccaggaccccaccatttcccatattatttctgagccccagcctggctgtcgctaatcttacttagggtgggtaattcttggggagagacagagaaggagacagagaacgtggatagataaccaggagcctctgctggttaccccagggagtggggctctatgatccaaaggagtaggatggagggtggcgctgaatggcttgtgcccatcatatgccctgtccccagcaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgcatttgtttctgtggaagtgtgtgtgcggtacctgaggggaggagcctcggcggtgttctccctttgtctcgagtcatttcttttctggctgtcactctcttggcatcaatatacccttctaggttttctacctctgtccattccttttcagcttttgtccctcacctgcagcctggaatgcccagccacctgctgggtgcctcacaggccactcaaactcaacctgtcccaaacagagctc

SEQ ID NO: 3590 - DNA, 6928 bp, Homo sapiens
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 3591 - DNA, 6907 bp, Homo sapiens
ggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagagcgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagt

SEQ ID NO: 3592 - DNA, 2598 bp, Homo sapiens
tgccaccctatgctgcctgcccctccttcagcccctgctcccatctccatccccagcacaacccccacaccccttccttcacctcctgcacagcccccaccctctgtctcctacttgcccttgcacctgcccccatcttccactccccacacctactctcatcctccccccagctcctgcttacccaaaaccggtccgggtccagctcggcggcccaagcctctgcccagcggactgcgcacccgcccgccccagccaatcccgccgccgccgccgcgccccgcccacaggacgttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctt

SEQ ID NO: 3593 - DNA, 1851 bp, Homo sapiens
atgcagtgcagttcttggtacctgcatgtaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctt

SEQ ID NO: 3594 - DNA, 7544 bp, Homo sapiens
tagagacagggtttcaccatgttagccaggatggcctcgaactcctgacctcatgactcaccacctcggcctcccagagtgctgggattacaggcatgagccaccacgcctggtctgtgtgtgcttgtgaattcttaaaggatgtgtgtaagggagtgatctaggggcactgcacccagtgggaactcgggagagtggccagttgtctgcaccactctcgctctaggccataaatgaaagtatgtgccctgttagaattgctttcttcctcctgctttcaggatgtttgcaggtgtcggggagggcagactatttttacactgttcctctgcgtttatccattaaagtaggagagatgctcccagtgaggctcaggcccttgtcagacagagtccctggacggtagcagagcctttccatggccaatgacttatcagagcttttttccttccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggtaaagccttctagaaagccctctttttttttcatacctttgtctgtctggtctgtgcaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaatcttctttggtggacactgtaaaaataatcaaatgagatactttgaaagtgcctcatgccttatttcctcgcctcccacagcaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcagatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtattggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaaggcaaggggggtgcttctgctgtgccatggcacaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccagggagagagccctagggcagggagtaatggcagcggcccttgggctgtcttccagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggtaacaagatggcggcccgcggtggggctgccgaggggtgaccctagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggtgggtagccatgtctagattttacccccaccatcccaggccgggctgatgtctgttctcacactgcttcctctgcttccaggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggtcactgctttctttttcaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctt

SEQ ID NO: 3595 - DNA, 1574 bp, Homo sapiens
cgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcaaaaaaaaaaaaaaaaaaa

SEQ ID NO: 3596 - DNA, 991 bp, Homo sapiens
ggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 3597 - DNA, 1195 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 3598 - DNA, 1129 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 3599 - DNA, 1129 bp, Homo sapiens; identical to SEQ ID NO: 3598

SEQ ID NO: 3600 - DNA, 1129 bp, Homo sapiens; identical to SEQ ID NO: 3598

SEQ ID NO: 3601 - DNA, 3536 bp, Homo sapiens
gactggcacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaagaaaaaaaaaaaaaaaa

SEQ ID NO: 3602 - DNA, 3669 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggcaaatttatctttctctcctcttcaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaaggcaactcctgtccctccttcctcacagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttca

SEQ ID NO: 3603 - DNA, 4825 bp, Homo sapiens
gagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattg

SEQ ID NO: 3604 - DNA, 3576 bp, Homo sapiens
aaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaaggcaaaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttc

SEQ ID NO: 3605 - DNA, 4561 bp, Homo sapiens
cgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacttaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggcacgaagggaactgagacggctgaaggaggaggctaggaataaacatgctattgcagttatttgggcttactggcttggatctaaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtacctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacgtgattggtacagggtgcctattttagt

SEQ ID NO: 3606 - DNA, 3387 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggcaaatttatctttctctcctcttcaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaaggcaaaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggag

SEQ ID NO: 3607 - DNA, 2787 bp, Homo sapiens
cgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacttaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaagctcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctc

SEQ ID NO: 3608 - DNA, 4387 bp, Homo sapiens
cgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacttaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtacctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacgtgattggtacagggtgcctattttagt

SEQ ID NO: 3609 - DNA, 1812 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactgtttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttcgaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctgcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataattgaa

SEQ ID NO: 3610 - DNA, 1223 bp, Homo sapiens
aattccgggcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataaaaaaaaaaaaaaaccggaatt

SEQ ID NO: 3611 - DNA, 1812 bp, Homo sapiens; identical to SEQ ID NO: 3609

SEQ ID NO: 3612 - DNA, 1296 bp, Homo sapiens
gaaggaatgctagagtgtgtgaaagtggaggacgcatcgtcaaaggacacctgaggacgtctcaaagaagctcggcgggagagctgagcgctcggaagaaccaagttatttctaaacagaactaagatcagaattctttgaatcatcagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaat

SEQ ID NO: 3613 - DNA, 7912 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3614 - DNA, 8647 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3615 - DNA, 7959 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3616 - DNA, 8371 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3617 - DNA, 2488 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactg

SEQ ID NO: 3618 - DNA, 8374 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3619 - DNA, 2443 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactg

SEQ ID NO: 3620 - DNA, 7823 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacactctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3621 - DNA, 8815 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3622 - DNA, 8278 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3623 - DNA, 8013 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacaggtcagctaaaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3624 - DNA, 8278 bp, Homo sapiens; identical to SEQ ID NO: 3622

SEQ ID NO: 3625 - DNA, 7848 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacaggtcagctaaaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3626 - DNA, 2402 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaaaaaaaaaaaaaaaaaaaa

SEQ ID NO: 3627 - DNA, 7823 bp, Homo sapiens; identical to SEQ ID NO: 3620

SEQ ID NO: 3628 - DNA, 8155 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3629 - DNA, 8272 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3630 - DNA, 8449 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 3631 - DNA, 7935 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacaggtcagctaaaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3632 - DNA, 8226 bp, Homo sapiens
ggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgccccacctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgattgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagcttt

SEQ ID NO: 3633 - DNA, 8278 bp, Homo sapiens; identical to SEQ ID NO: 3622

SEQ ID NO: 3634 - DNA, 3697 bp, Homo sapiens
cccacgcgtccgggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaaattttttttttttttttttaagaatatctgtaatggtactgactttgcttgctttgaagtagctcttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcaaaaaaaaaaaaaaaaaaaaaaaaaaaaaaaaa

SEQ ID NO: 3635 - DNA, 3152 bp, Homo sapiens
gacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgaggttatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgt

SEQ ID NO: 3636 - DNA, 3152 bp, Homo sapiens; identical to SEQ ID NO: 3635

SEQ ID NO: 3637 - DNA, 3152 bp, Homo sapiens; identical to SEQ ID NO: 3635

SEQ ID NO: 3638 - DNA, 3152 bp, Homo sapiens; identical to SEQ ID NO: 3635

SEQ ID NO: 3639 - DNA, 4170 bp, Homo sapiens
gcgccggggggcgcgcacgcagggggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcacagcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataagggtacggccagggcgggctggggccagggctgcctcgaggggatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctatct

SEQ ID NO: 3640 - DNA, 4230 bp, Homo sapiens
cttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcacagcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctatct

SEQ ID NO: 3641 - DNA, 4230 bp, Homo sapiens; identical to SEQ ID NO: 3640

SEQ ID NO: 3642 - DNA, 3640 bp, Homo sapiens
atgagcagcgcccctcggcgccccgccaagggcgcagattctttctgtacgggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcacagcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctatct

SEQ ID NO: 3643 - DNA, 2773 bp, Homo sapiens
ctgaggggccctctgtgccatcttatgctaggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctatct

SEQ ID NO: 3644 - DNA, 560 bp, Homo sapiens
aactggagaggggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagagtaggttagcctgactgtgctatcacagcataggagcaagacaggaaatggaactgcataaatctcctt

SEQ ID NO: 3645 - DNA, 966 bp, Homo sapiens
aactggagaggggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtctttttctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 3646 - DNA, 409 bp, Homo sapiens
gcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagacggagttttgttcttgttgtccaggatggagtgcaatggcatgatctcagctcaccgcaacctctgcctcccggattcaagtgattctcctgcctcagcctcttga

SEQ ID NO: 3647 - DNA, 987 bp, Homo sapiens
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatgaaaaaaaa

SEQ ID NO: 3648 - DNA, 1073 bp, Homo sapiens
aactggagaggggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtctttttctgatttttaaagtactttcttataaatttggatcatgttatgatttgtaacattcacacaacacctcacttttgaatctataaaagaattgcacgtatgagaaacctatatttcaatact

SEQ ID NO: 3649 - DNA, 966 bp, Homo sapiens; identical to SEQ ID NO: 3645

SEQ ID NO: 3650 - DNA, 759 bp, Homo sapiens
attccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagttattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgt

SEQ ID NO: 3651 - DNA, 957 bp, Homo sapiens
gtccccactcgacccaggaagtccagctggcttcacctctcaccaggccctgttttaagcactgtttatttatttaatcatgacaaaaatccccatgagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtctttttctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 3652 - DNA, 957 bp, Homo sapiens; identical to SEQ ID NO: 3651

SEQ ID NO: 3653 - DNA, 2148 bp, Homo sapiens; identical to SEQ ID NO: 3095

SEQ ID NO: 3654 - DNA, 7950 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgaggacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcgcggactgccaggctatctagggtctccaggaatcccaggagttgatgggcccaaaggagaaccaggcctcctgtgtacacagtgcccttatatcccaggacctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagactggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctagacaaatacccaagcaacaactccgcaggcagttacccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattattcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattggagctggtccttttttttcaaaatggaaataaattttttttggattgtaagaa

SEQ ID NO: 3655 - DNA, 7991 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacaccgggctacccagggatcccgggtgctgctggtttgaaaggacaaaagggtgctcctgctaaaggagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggacagaaaggggacattggccctccaggatttcgtggtccagtaaaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcttgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcgcggactgccaggctatctagggtctccaggaatcccaggagttgatgggcccaaaggagaaccaggcctcctgtgtacacagtgcccttatatcccaggacctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagactggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctagacaaatacccaagcaacaactccgcaggcagttacccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattattcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattggagctggtccttttttttcaaaatggaaataaattttttttggattgtaagaa

SEQ ID NO: 3656 - DNA, 8096 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggtgctgctggtttgaaaggacaaaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgg

SEQ ID NO: 3657 - DNA, 2400 bp, Homo sapiens
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 3658 - DNA, 2389 bp, Homo sapiens
taatgagagggaaaacaagtatgaagctgtgtggctgaaaccgtcttggcaagttagggaaagaaaacggaagtcactggggctgatcacagtgctaagcatgagagcactgcaagatgaggtcacggaggtgggcagggaccggcttgtgccaggccttgctggcagggtgaagagtttgccttttctctgcgtacaatggaaaggagaagaggttttaagcaagagaatggcttggtcatgtgtatgtctttgagacaccctggctagtctatgtatgatgcaaaaggtgggtggggcagggtgacaagaaaatactgttccggagcttcctgtggctgtgcctataagaggtggtggtggtggtgtggaaggaggtgtggcagtgaataaacagagatgtagaaacagcgtgtacatatattttaaggaacactgaggacgtgatgctggaatttgtgatgagagagtggaaaaaatccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgctcctcggctgcggagagggatggcagtggcacgaataagcgggacaagcaataccaggcccaccgggctttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 3659 - DNA, 2743 bp, Homo sapiens
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctgagagccctttgccctcacacagggtcagctctgggcaacaaagagggagtggctcagacagggtcagagaagtctcatcccagactctggcttccagcatcatctgttcctgggggccaggccctgcgcagacctggccacccagggtgctggacacccccaaccctgactccacaaggacccagcagggcccatgggcccaggccagcacggaggggactcatgcagatgcagaggccaagctccccaggtgggcctggcacgcctccccgcagggctcctcctcaggccattcctgccaccctgagtcctctaccccagtgacctgcatcaggctc

SEQ ID NO: 3660 - DNA, 2940 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgacacaacggcgacgacagaaccagcagttcacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccatagtgcatagctactaaaatcagtgaccttgaacatatcttagatggggagcctcgg

SEQ ID NO: 3661 - DNA, 2940 bp, Homo sapiens; identical to SEQ ID NO: 3660

SEQ ID NO: 3662 - DNA, 3512 bp, Homo sapiens
gacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagagagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagccacaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaag

SEQ ID NO: 3663 - DNA, 2940 bp, Homo sapiens; identical to SEQ ID NO: 3660

SEQ ID NO: 3664 - DNA, 2940 bp, Homo sapiens; identical to SEQ ID NO: 3660

SEQ ID NO: 3665 - DNA, 5522 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcaggtctttgggaggagccagtcgctacctggagcagactctctcctcgccaagcccattgacaagcagcacacagacactgtggtgaacttccttatccgcgtggcctgtcag

SEQ ID NO: 3666 - DNA, 13113 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaagg

SEQ ID NO: 3667 - DNA, 12535 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaa

SEQ ID NO: 3668 - DNA, 12676 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaa

SEQ ID NO: 3669 - DNA, 4009 bp, Homo sapiens
acaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggcctccgcagcgccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaaaaaaaaaaaaaa

SEQ ID NO: 3670 - DNA, 4159 bp, Homo sapiens
attgccgcagatttgcagtcacttcagactgggtggagtatccaagtccatagaagagcaaattctcacccttcgaggctgctgtggaagctaccggggctgggacagcagagaggaacccagacgggaacaccgccctcccgccagactcccggcggctcctcctccctctcccaaacccactcccaaagctaagtgcaggcttccccgttccagccagaagcgctgcgtgagcctccacacgtagccgcagcactccttaaatagcgtccgcgctgagcaaacagtccagacgtggggcccaggaggcgagctgaggcaccgcaccggcggcaccgcggcgggtcagcggcggccaatagccagggcgcggcgcccccgtcgcctcccctcggagcctataaggctccgcagcgccccgggctgctgctccgtgcctccaccgacgacctcactcagctgcgttacggccgctccggtgccggcgcgcgccttgcccgccgctcccgcccgcaatcggcggctcagggcggacccgggtctctgcgttctcgcgagaagcgcggcgctgcggggccgtgggcgcctgagcccagccagcctcgagggccgaatatggggggatgcacggtgaagcctcagctgctgctcctggcgctcgtcctccacccctggaatccctgtctgggtgcggactcggagaagccctcgagcatccccacagtctttgcagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaagttttgttgttctattattggtgtttatcttccaaagtgaatac

SEQ ID NO: 3671 - DNA, 4150 bp, Homo sapiens
attgccgcagatttgcagtcacttcagactgggtggagtatccaagtccatagaagagcaaattctcacccttcgaggctgctgtggaagctaccggggctgggacagcagagaggaacccagacgggaacaccgccctcccgccagactcccggcggctcctcctccctctcccaaacccactcccaaagctaagtgcaggcttccccgttccagccagaagcgctgcgtgagcctccacacgtagccgcagcactccttaaatagcgtccgcgctgagcaaacagtccagacgtggggcccaggaggcgagctgaggcaccgcaccggcggcaccgcggcgggtcagcggcggccaatagccagggcgcggcgcccccgtcgcctcccctcggagcctataaggctccgcagcgccccgggctgctgctccgtgcctccaccgacgacctcactcagctgcgttacggccgctccggtgccggcgcgcgccttgcccgccgctcccgcccgcaatcggcggctcagggcggacccgggtctctgcgttctcgcgagaagcgcggcgctgcggggccgtgggcgcctgagcccagccagcctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaagttttgttgttctattattggtgtttatcttccaaagtgaatac

SEQ ID NO: 3672 - DNA, 4150 bp, Homo sapiens; identical to SEQ ID NO: 3671

SEQ ID NO: 3673 - DNA, 10724 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgtgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagctacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttgcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttatgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttcccttggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaagagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacagaaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttaaactaatttccaaagaatttagctgaagactcagagtcagcctacctcttgactctccacatccgcatctaagatcctgaaggccaaaggaatgcgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattgttaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatatacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgagtaccagcttcagtgactcaatcatttatacaggatttcagtgttttgttctgcagcggtgttctaaagggttcacatagtataatggaggagggacaaagcagaatatacttccaagctggaacatctttaagacatttacaaactgttatgggacactatcagcaactacgcctggggaagctagcaggatttagctcttcaatggccctccaaatgcacccaacaatcgccaacctcacccatggaaatcatctaaaaaatgaaaagaagggccttaaagtcctcacatggatgctgtatttataactaaaatgtacagtttaattctaaatagcaggcttttaaatgcaaacagcttccaggtgagtcctctggctgccaatcagactgctgattctaaaccattctcacacagaatttctgaaaccaacaccaggtattaattgttaactgcagtgaaaggaaaccaaggcacattacaaaaggctaaatgctgctgtttctaagtggaagcactgttgaacaacactcttaggtggaataagaaaattagggttaaactgtaacattgtaatcggacgaacaaatcagcatctttgatcctcaggttaaaatttaatcttaaatttagaaattcaaagtaacagcctttaaccattaaccttgaggaaaatgtgaagtagcatctggagtctcttaagccccagccctgttgtcccctacagcatctccacccaggaagtccagttcctaactaatgggaatggatccttttcccattataaagggccgatgcttaacccttgaacccactactgttcttatgccccaagatctgcaccttacatcaggcacccgggaatgcttctcattgaaattttaccataccaaaaaatatgtaagggtgactcatcactcctaactttggactccttgctttgagatcggtatttttttctctctctttacatatagcaaaagctttccccagtagctgatgaatttagaactttatacaagactccctagcattttcctcctcccacaggctggagaatttcagtgctatgagactgggcagtaggagccagagccaatttgcaggatctcttttccttctgccttccagttggcttctcttctcagctgcgtggtggggatgatttggggtttcctcagcaaggccattctctgccttgtgcccatagcagggccttgggtggtgacatgttatctttgttggtgagcagacactcagagatcctttaattatctgacacaccagggaaatcttggcaatcaactaaggacctgtgacactcataactatgtttacatttggctttagcatatttcaggtaatatctttatgaaaaaaagatgaagtatggaattgtaggaactcttttgcaatagactgagatccaatgtttaaatctttttatttcagtttgatctgtgcctttagattggggacaaaattttaaaaacaaatcttccaaatgacaccacaatgaaagccagttgtggtcttgaaaaatctctctattgcattacttatcctcacccttgttttttaagaggtagagagagattactgggaagcagtgagccaacataattgtcctttcctctacagaatagctgtgcagaaggggaccaccacacttaggaccagtgccaggtgacaatctttccgtcatgctgctgcagcattttgcaccttgagagacaggaaaaaaaatgggggtgagggagtggaagatgatgaaactatttctcttttatgtctacatccttactcctcaaaatactttaagctcactcagaccccatataccctgcccacaatactaacacatgtactttgcataagtaaattgttgattaaataagagcaaaactatattcttatgtgtagattaaccaaggctaatttcctggagtttaatacactttggattcaagtaaaaacaatcacttaatgcagcaacatctcagaccctcttcactctagaaccgttttatacaagagaactcaacatttactgttttatttctgatattgcctgccattactcaggatgcaagagatgctctgcattccttattaggaaaaattggcctgtaaggagaatggtatactgcgtattactactgtgagactgtaaaattgttaatggacagtgtaaagaattgtattcattttattagcaagaaaaatattgcatacaagaactactgccctgaaatatccatcactccaatgaactgttctgcctgatctaacataaagttatatttcattgctcatttttttttgcctcactaaaatgactaacttaagggaatgtgcatttctacaagactttaattggataaactcattagaagaaaatgtttcgattgcattcaggaacaaagaagcataacctttgttgactcttgtaatttattatatgcttcatttaaacccattttgtaaagaaatcaggtaacagtcatttaatctgatataattagaaatagctgagagagtaaaaaagcattttgaatgtcctatgtatggcatatcctgtacaccaattgaaggtcagagctttggtatttttgtataattctgtcttatctggtgcatcagctgtgtattttacgtcaaggtaaatgagcatcctgttttatatgttaaattttaaaaatgactttttcaaag

SEQ ID NO: 3674 - DNA, 10724 bp, Homo sapiens; identical to SEQ ID NO: 3673

SEQ ID NO: 3675 - DNA, 4811 bp, Homo sapiens
ggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgtgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttatgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttcccttggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaagagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcaaaaaaaaaaaaaaaa

SEQ ID NO: 3676 - DNA, 1761 bp, Homo sapiens
tcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttacta

SEQ ID NO: 3677 - DNA, 2930 bp, Homo sapiens
tggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccttcctcgccggcgtccgcgtccccgcgccgagctgctcgggctccctgagcccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgaggttagtagccaagagagaagataagggatgtctttttccaagaaggatgtctcaccaagtctgtttctcaacagctgattgggcagaaagtggcccatgctctggcagagggactcggagtaatcgcctgcattggggagaagctagatgaaagggaagctggcatcactgagaaggttgttttcgagcagacaaaggtcatcgcaggtatctctggagaaagggacctttgagcctatccagggccacagagactcagagggtagggtcaggccctggagcctgtcttggtccccatgctgatccagaaaaggaaaaaggggagggggagtgacaatctttgcttggggcctatgacttctccagccccaaggtagatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttacta

SEQ ID NO: 3678 - DNA, 1225 bp, Homo sapiens
gacactgaccttcagcgcctcggctccagcgccatggcgccctccaggaagttcttcgttggggggaactggaagatgaacgggcgaaagcagagtctgcgggagctcgtccgcactctgaacgcggccaaggtgccggccgacaccgaggtggtttgtactccgcctactgcctatatcgacttcgcccggcagaagctagatcccaagattgctgtggctgcgcagaactgctacaaagtgactaatggggcttttactggggagatcagccctggcatgatcaaagactgcagagccacgtgggtggtcctggggcactcagagagaaggcatgtctttggggagtcagatgagctgattgggcagaaagtggcccatgctctggcagagggactcggagtaatcgcctgcactggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactagg

SEQ ID NO: 3679 - DNA, 1665 bp, Homo sapiens
tcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctcctttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctat

SEQ ID NO: 3680 - DNA, 1761 bp, Homo sapiens; identical to SEQ ID NO: 3676

SEQ ID NO: 3681 - DNA, 2346 bp, Homo sapiens
ctcgcatctctctgcagcagcctccggggctacgttccatcctatcagtctgagaccagcccagaagaaaaaaaccaaaaatccttaattatcttcttttgctcggtacctacattgggaccatcaaaaaaaaattattacagtaaaccgtagccatgagggaaatcgtgcacatccaggccggacagtgtggcaaccagatcggtgctaagttctgggaggtgataagcgatgaacacggcatcgaccccaccggcacctaccacggagacagcgacttgcagctggaccgaatctctgtgtactacaatgaagctacaggtggcaagtatgtccctcgagctatcttagtggatctagaacccgggactatggactccgttcgctcaggtccttttggccagatcttcagaccggacaactttgtttttggtcagtctggggcaggcaacaactgggctaagggtcactacacagagggagctgagctggttgactctgtcttggatgtggtgcggaaggaggcggagagctgtgactgcctgcaaggctttcagctgacccactcgctgggtggaggcacgggctctggcatgggcaccctgctcatcagcaagattcgagaagaataccccgaccgcatcatgaacaccttcagcgtggtgccctcacccaaagtgtctgacaccgtggttgagccctacaacgccaccctgtccgtccaccagttggtagagaacacagatgagacctactgcattgacaacgaggctctctacgacatctgcttccgtacccttaagctcaccacgccaacctacggagacctgaaccatctcgtctctgccaccatgagcggtgtcaccacctgcctccgtttcccgggccagctgaacgccgaccttcggaagctggctgtcaacatggtgcccttcccgcgtctccacttcttcatgcctggctttgcccctctcaccagccgtggaagccagcagtaccgggccctcactgtgcctgaactcacccagcaggtcttcgacgccaagaacatgatggccgcctgtgacccacgccacggccggtacctcacggttgcggctgtcttccgtggacggatgtccatgaaggaggtagatgagcaaatgctcaacgtgcagaataagaatagcagctacttcgtggaatggatccccaacaacgtcaagacggctgtctgtgacatcccaccgcgaggcctcaagatggcagtcaccttcatcggaaacagcacggccatccaggagctcttcaagcgcatctctgagcagtttacggcaatgttccgtcggaaggctttcctccactggtacacgggtgagggcatggacgagatggagttcaccgaagctgagagcaacatgaatgacctcgtctctgagtatcagcagtaccaggacgccaccgcagaagaggaagaggatttcggagaggaggcagaagaagaggcctaaggcggaagccctgcgtcacctcaggctgcttagttcccttagcttttttccaactgccctttgtttctttctgctgcctctgtcctgtttttgttccgttttgttttctcattggggggtaaacggtgcctggcacgtggcaggcgctcaataaatatttctttgtggaatgtctcctttctctttccgatctgacattctgagcgttaaccctgtgcttcctcctggtacccatttctttattatgactgtccagttaatattcttccaatatattctccaggaaccagcgttcggctccagacccggggtagaacccagcccagttctaagaactcaagagagtagccaccatcttaaagcaaagtagcgggtggggaaaaggtgggtagaggagatgctacttagggggtgggattttccagtcagggccatttagacacgggaatcgctggggctttcagtcgatggggctttcttttttccctgcttcatctctcggcctcaggagaggtattaacagtattatcaccatttatatcctagctgtcctgagccaaatctgccattggaggtgtcttcccctgtgttggttctccaagggacgttgtatggggatttgtgggggcagggcagcaaggccttgttctctaaatgtccagaaacactctaattaccatttccacctgggtgcctcacacactccccagaggggaggtaacatctctgccccatttccatcctgttccttggcttggtcattccctacctttctattttctgttaaacttggctttttttttttcatattgaaaagatgacattgccccgagagccaaaaataaatgggaattgg

SEQ ID NO: 3682 - DNA, 2505 bp, Homo sapiens
gcccctccgcccgcggccacgcccctccgcccgcggccacgccccttcccagcccagagcctttcccctcgtccccgtgactctgcggaattttctccactcggatctctctccgcttttcgctctcctttccgtttccggccttccaagctcggctccaggttcctttctccctgctgtctctccatcgccctggttctccctctctgccgctctttcccgggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggat

SEQ ID NO: 3683 - DNA, 637 bp, Homo sapiens
agaacatgatggctgcctgtgacccccgccacggccgatacctcaccgtggctgctgtcttccatggtcggatatccatgaaggaggtcgatgagcagatgcttaacgtgcagaacaagaacagcagctactttgtggaatggatccccaacaacgtcaagacagctgtctgtgacatcccacctcgtggcctcaagatggcagtcaccttcattggcaatagctcggccatccaggagctcttcaagcgcatcttggagcagttcactgccatgttcggcaggaaggccttcctccactggtacacaggcgagggcatggactagatggagttcaccgaggctgagagcaacgtgaacgacctcgtctctgagtatcagagtaccaggatgccaccgcagaagaggaggaggattttgttgaggaggccgaagacgaggcctatgacagagcccccatcacctcaggcttttcagttcccttagccatcttactcaactgcccctttcctctccctcagaatttgtgtttgctgcctctatcttgttttttgttttttcttctggggaggtctagaacagtgcctggcacatagtaggcactcaataaatacttgtttgttgaaaaaaaaaaaaaa

SEQ ID NO: 3684 - DNA, 2307 bp, Homo sapiens
cctatccaggtgagaactggccactctaatttacccggaagcctttctgcaggagattcaaatatttgctaatgcttactgacaccttcactggttagatcgagacattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggattcacagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtgagctgcaggcgaggactggggtgcggctccttagccagggcagctcaaaatccaggagtgtgctaaggtcatcctctgggaactgtggagctagggcccctgaacaccctcctatcctccgagtcgagtcgctcaatctgcctctcctaaatgggcttcgggaggaaggccctggtgtctcctcaaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtat

SEQ ID NO: 3685 - DNA, 1561 bp, Homo sapiens
atgagggaaatcgtgcacatccaggctggtcagtgtggcaaccagatcggtgcctgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgt

SEQ ID NO: 3686 - DNA, 1561 bp, Homo sapiens
gctcctcccgaagtgctcctcttctacagctgttccgcagtcgccgccgccatgagggagatcgtgcacctgcaggctgggcagtgcggcaaccagattggcgccaagttctgggaggtaatcagcgacgagcatggcattgatcccactggcacttaccacggagatagcgacctccagctggagcgcatcaacgtgtactacaacgaagccaccggtggcaagtatgtgccccgcgccgtgctcgtggacttggagcccggcaccatggactcggtgcgttcagggcccttcgggcagatcttcagacctgataacttcgtctttggtcagagtggggctgggaacaactgggccaaggggcactacacagaaggtgcagagctggttgactcggtgttggacgttgtgagaaaggaagctgagagctgtgactgcctgcagggcttccagctgacccactccctgggtggggggactgggtctgggatgggtaccctccttatcagcaagatccgggaggagtacccagacagaatcatgaacaccttcagtgtggtaccttcccccaaggtgtcggacacagtggttgagccctacaatgccaccctttcagtccaccagctggttgaaaacacagatgagacctattgtattgataatgaagcactttatgacatctgcttcagaaccctaaagctgaccacacccacttacggtgacctgaaccatctagtgtccgccaccatgagtggggtaaccacttgcctgcgattccctggccagctaaatgctgacctgcggaaactggctgtaaatatggtgcccttccctcgcctgcacttcttcatgcctggctttgcccccttgaccagccggggcagccagcagtaccgtgccctgacagttcctgagctcacccagcagatgtttgatgccaagaacatgatggctgcctgtgatccaagacatgggcgctacttgactgtggctgccgtgttcaggggccgcatgtctatgaaggaggtggacgaacagatgcttaatgtccaaaacaagaacagcagctactttgttgagtggatccccaacaatgtgaagacagctgtctgtgacattccacctcggggcctgaaaatgtcggccaccttcattggcaacagcaccgctattcaggagctgttcaaacgcatctcagagcagttcacagccatgttccgacgcaaggccttcctacactggtacacgggtgaaggcatggatgagatggagttcactgaggctgagagcaacatgaacgacctggtgtccgagtaccagcagtaccaggacgctacagctgaggaagagggagagtttgaggaggaggctgaggaggaggtggcttagagctgtcttagtcactaaagcatgggagcagtgtgaactctttattcattcacagcctgtctgctagccatgtccactgtgcatttgctgtcctgtgtcctgacatcacttgtacagataccaccattaaagcaattcatagtgtgaaaaaaaaaaaaaaaaaaaaaaaaaa

SEQ ID NO: 3687 - DNA, 1944 bp, Homo sapiens
cgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagcaca

SEQ ID NO: 3688 - DNA, 1440 bp, Homo sapiens
atggactttagacatcgcgcctgttttgtactctccaagccggacttctctactcgctggcctggcgctgatgcccagaggccccctgtgcttgtggtcgtggccttagacagttccctgccctttagacatctttcaagcccatcccagaggagagtggcctctctcctcaaccccaagaggacggcctctcatgtggctgtcacccatctgacccctatcacagacctgaggaaacgaacctacacaagtgaaggcaaaggaagcctcttgaaagataaggcaggaaaaatgaggatagaaaacaaaacccttctagagagtttacgtggaggctaccacgggcatcgctgctctgcagtctgtcaaccagaggcccctggtcagtgtggggccagaaaaaactgggccaagggacactacacagaaggcaccgagctgatggagtcagtgatgtacgttgtcagaaaggaggctgagagctgtaactgcctgcagggtttccagctgacccactccctgggttgggggactgggtctgggatgggtacccttctcattagtaagatccgggaggagtacccagacaggatcataaacacattcagcgtcctgccctcgcccaaggtgtcggacaccgtggtggagccctacaacgccaccctctcagtccaccagctcatagaaaatgtggatgagaccttctgcatagataacgaagcgctatatgacatatgttccaggaccctaaaactgcccacacccacctatggtgacctgaaccacctggtgtctgctaccatgagtggggtcaccacgtgcctgcgcttcccgggccagctgaacgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggccgctacctaacggcggctgccattttccagggtcgcatgcccatgagggaggtggatgaacaaatgttcaacattcaaaataagaacagcagctactttgctgactggctccccaacaacttaaaaactgccgtctgtgacatcccaccccgggagctaaaaatgtcagtcaccttcattgggaataatacggccatccaggaactcttcaagcgtgtctcagagcagtttacagcaatgttcaggcgcaaggccttcctccattggtacacgggcgagggcatggaagagatggaattcaccgaggccgagagcaacatgaacgacctggtgtctgaatatcagcaatatcaggatgccacggctgaggaggaggagtttgaggagtatgctgaggaggaggtggcctag

SEQ ID NO: 3689 - DNA, 1760 bp, Homo sapiens
atggcctgcgggtctgaccaccatcgcctagatgacccacttaagggtcacttaaggccccacttcctgcccaacacggcttccttcagctacaagagcagctacatcaccaacaacacctgcaccaggcaccccgaagatgtcctcgctggagagggcccgtgccaggctgggttcctgcgggcagctggactctgccaggggcagggggaagggaaatcagacccagcggaggtggagctctcagaggcgccccgggggcgcagggaccgagctccgccgccgccgccgccgcagcctcgcccgccgggcgccccgcagctcccagctcccagctcccagctcccagctcccagcatccgcgccgccgccgccgccgcccccagcgccaccgccatgcgggagatcgtgcacctgcaggccggccagtgcggcaaccagatcggagccaagttttgggaggtgatcagtgatgagcatggcatcgaccccacgggcacataccacggggacagtgatctgcagctggagagaatcaacgtatactacaacgaggccacaggaggaaattatgttcccagagcggtgctggtggacctggagcctggcaccatggactctgttcgctccgggcccttcggccagatcttccggcctgacaactttgtgtttggccagtccggagccggcaacaactgggccaagggccactacacggagggcgccgagctggtggacgcggtcctggacgtggtgcggaaggaggccgagagctgcgactgcctgcagggcttccagctgacgcactcgctgggcggcggcacgggctcgggcatgggcacgctgctcatcagcaagatccgcgaggagttcccggacaggatcatgaacaccttcagcgtggtgccgtcgcccaaggtgtcggacacggtggtggagccctacaacgccacgctgtcggtgcaccagctggtggagaacacggacgagacctactgcatcgacaacgaggccctgtacgacatctgcttccgcaccctgaagctgaccacgcccacctacggcgacctcaaccacctggtgtcggccaccatgagcggcgtcaccacctgcctgcgcttcccgggccagctcaacgccgacctgcgcaagctggccgtcaacatggtgcccttcccgcgcctgcacttcttcatgccgggcttcgcgccgctcaccagccgcggcagccagcagtaccgcgcgctcacggtgcccgagctcacgcagcagatgttcgacgccaagaacatgatggccgcgtgcgacccgcgccacggccgctacctgacggtggccgccgtcttccgcggccgcatgtccatgaaggaggtggacgagcagatgctgagcgtgcagagcaagaacagcagctacttcgtcgagtggatccccaacaacgtcaagacggccgtgtgcgacatcccgccgcgcggcctcaagatggccgccaccttcatcggcaacagcacggccatccaggagctgttcaagcgcatctcggagcagttcaccgccatgttccggcgcaaggccttcctgcactggtacacgggcgagggcatggacgagatggagttcaccgaggccgagagcaacatgaacgacctggtgtccgagtaccagcagtaccaggacgccacggccgaggagggcgagttcgaggaggaggccgaggaggaggtggcctagggctgcgccagcgccgggccggggagccc

SEQ ID NO: 3690 - DNA, 1418 bp, Homo sapiens
ctacttcctcctgcttccccgccgccgccgccgccatcatgagggaaatcgtgcacttgcaggccgggcagtgcggcaaccaaatcggcgccaaggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtg

SEQ ID NO: 3691 - DNA, 1944 bp, Homo sapiens; identical to SEQ ID NO: 3687

SEQ ID NO: 3692 - DNA, 1604 bp, Homo sapiens
cagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaacctt

SEQ ID NO: 3693 - DNA, 5117 bp, Homo sapiens
atgaggctttgtctccctaccgcgccgcgggccgattctcccgcctcccagccccggcgcaccgcgccccgcccagcctcctttcctcgccgccctccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcaatgtggcaaccagatcggtgccaaggtaagaattttacacctcttttatttctttttacaaggaaaaatccaggtaagttatgaaaaaatggttgtggggcatttgcacccgctatccttaatcaagatttccccctctcaagtttgttacatttatatatataacaattgtagctagcatttccctttggaaagctgggaatcatttttcttcgcaggcacattttggagaaactagtaaaagggctcttcgggtttgggggcggggaagaccgaggacttataagatgttacttaaaagggcttctaacggtccaaaaccgggcagggagagagatgcggaaacggtcgcagacaaagcggggccaggttttgcccatgtgcatcccgcccaaccctgcggggtacttagggccaaaccggagcgggaaggggtgaggccatcgggcgctgcagagagctccagcgcaagggtggggggccgatgcgcagggtgggctgcgctgggcgtacctttcacaaaagaccagggaccccaacgcgcccggaccccagaggccggtcctgtatttgttcctggatggaaggagaataagaacgggatttaattttccattgctttcatggcccctaagagagacttttttagggcgttgaacaggattactgtcgagaaaatgggggtgtgtggttttctttaatgagtccctcaggacttaatgggagagaaagaatcctttaaatcaagggtagaaatgtagcgaaggaataaaaattccgaggccaagggggattttttttttttgcgcgcggttacaggtgtagcggagggaggggcgggaggaagtgcggctgctacgttgtagcagaagggcggggctgcgggcgcgcgacgaggcgacgtcgatgggcggggtacaaatgcggcggttgccgccggcagggcgcgctaccttgggccccgcctcgcgcgaggaagtttttgtccctggccccgccacgcgcgaagtcttttgtcggcggctgacctgcgcgtccgcagtcacctggagggcggggggggtggtcgactgcgcggccagctctttcctcagacccccagccttttgtgcgccgcgggtggggcggtgccagcttgggggaaggagagcggcgttatcgaagtgtggtcgacctccatccgcccaccgagcattgggacccgctgcacatatccagagcagggaaagctgtggctttctcgggggagcgagtgtctaggggaagggtgtggcaggcccagggatccctccaggtacaggggttcgagaccatcctgggcaacaaagcgagacccctcccccatggcattttctacaaaaaataaaagtaaaaaattagctgggcgtggtggcgcgcgttctgtggtcccagctactcgagaggctgagatgggaggatcggttgagcctgggagttccacgctgtagtcatccggtggactgcaggctgggcccaggaagacctgtcttaaaaattagaagaagctgggctgggcgtggtggctcacccttgtaatccagcactttgggaggccaaggtgggcggatcacgaggtcaagagatctagaccatcctggccaacatggtgaaaccccgtctctactaaaaataacaaaaagttagcctgggcgtgttgtgcgcgcctattgcccagctactccgggggcctgaggcaggagaatcgctgacccgggaagcagaggttgcagtgagccgagatagcgccactgcactccagcctggtgacagagcgagactccgtctcaaaaaaaattaagaaaaaagatgaaataaaatggtagttggggccatagttggctgggacttgacctgttgtggtctcgttgctccccctcggccagttctgggaggtgatcagtgatgaacatggcatcgaccccaccggcacctaccacggggacagcgacctgcagctggaccgcatctctgtgtactacaatgaagccacaggtaagggcaggaggcgcagctcaggttcccttccctgtctcccacttatctgggatctctttccatttctgggcagcgcttatcccctttggtgaatctttcatttttgtcccctttcgtgaacccacgtcggggcccaaagcaggttctgctgccaccgggtcgggaccctggaatgacaagtctctgatccctgctgtctcccatttccagtatatctataaaccttcccttctgccagatttcacacctcttaactttattctctgtaggtggcaaatatgttcctcgtgccatcctggtggatctagaacctgggaccatggactctgttcgctcaggtccttttggccagatctttagaccagacaactttgtatttggtgttatacagatgatattagcagatgatatacgatctgttcaacttatttggggcaaggacacaggaaaagttaggagatgagtgttgtattggaatgctaatacagaaatatgttctgaaatctaacggagggtagaggtaatgcctactattgctggtaaattatggggcagtagggggagaatatatcacagtgaaggacaaaaggagatacatccgagggaattatttgaaaagttgaaagatggaaacatcatgtatcttccataccctgttaattagcttttctcctgactggcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaggctgaccacaccaacctacggggatctgaaccaccttgtctcaggcaccatggagtgtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggacctcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggagagcccccatcacctcaggcttctcagttcccttagccgtcttactcaactgcccctttcctctccctcagaatttgtgtttgctgcctctatcttgttttttgttttttcttctggggggggtctagaattccagaacagtgcctggcaatagtaggcgctcaataaatacttgtttgttgaatctctcctctctctttccactctgggaaacctaggtttctgccattctgggtgaccctgtatttctttctggtgcccattccatttgtccagttaatattcctcttaaaaatctccaagaagtgggtctccagatcccatttagaaccaaccaggtgctgaaaacattagtagataattggccatcatcctaagccaaagtagaaaatggtagaaggtagtgggtagagtcactatataggaaggggatgggattttcccattctaaagttttggagagggaaatccaggctattaaagttcattaaatttttaagaagtatgtccatttcccatctcactttcaagggaggtgtcagatattatctccatttcaatctccctccaagctctactctggaggatctgtcccatctgtcaagttggaatctccttccctttccaactctacctccctatttagcctctttcccctattagagaaaggggacttaggggggttgggaggggggaaagagaccagccttggtccctaagcctccagaaaggtcttcttaatccccaccttttcttactcccaaaaaagaatgaacacccctgactctggagttggtgatatctgccacatcagtgtttgagtcagttccccagaggagaggggaacctcctccatcttttttgcaacacctcatttcttccttttgcctgttgccttcccccctcacacactttggttttttttctatcctacattttgagatttctattttatgttgaaccttgcctgctttttttcatattgaaaagatgacatgccccaagagccaaaaataaatgggaattaaaaagctgcgagatgtgtgctattagg

SEQ ID NO: 3694 - DNA, 2580 bp, Homo sapiens
cccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagct

SEQ ID NO: 3695 - DNA, 1351 bp, Homo sapiens
atgcgtgagatcgtgcacatccaggcgggccagtgcggcaaccagatcggcgccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtc

SEQ ID NO: 3696 - DNA, 1663 bp, Homo sapiens
aaacttcctgccgccgcgttcgcacctcgctgctccagcatctagggcatattccaaccttccagcctgcgacctgcagagaaaaaaaaattacttattttcttgccccgtacataccttgaagtgagcaaaaaaattaaattttaaccatgagggaaatcgtgcacatccaggctggtcagcgtggcaaccagatcggtgccaagttctgggaggtgatcagtgatgaacatggcatcgaccccactggcacctaccacggggacagcgacctgcagctggaccgcatctccgtgtactacagtgaagccactgatggcaaatatgttcctcgtgccatactggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctcacccactcactgggtgggggcacaggctctggaatgggcactctccttatcagcaagatccgagaagaataccctgatcgcatcatgaataccttcagtgtggtgccttcacccaaagtgtctgacaccgtgatcgagtcctacaatgctaccctctccgtccatcagttggtagagaacactgatgagacctattgcattgacaacgaggccctctatgatatctgcttccgcactctgagggtgaccacaccaacctatggggatctgaaccacctcctctaagacaccatgagtggtgtcaccacctgcctccgcttccctggccagctcaatgctgacctctgcaagttggcagttaacatggtccccttcccacgtctccatttctttatgcctggctttgcccctctcaccagccatggaagccagcagtatcgagctctcacagtgccggaactcacccagcaggtcttcgatgccaagagcatgatggctgcctgtgacccccgccacggccgatacctcaccgtggctgctgacttccgtggtcggatgtccatgaaggaggtcgatgagcagatgtttaacgtgcagaacaagaacagcagctactttgtggaatggatccccaacaatatcaagacagctgtctgtgacatcccacctcgtggcctcaagatggcagtcaccttcatcggcagtagcacggccatccaggagctcttcaagcacatctcggagcagttcactgccatgttccgccggaaggccttcctccactggtacacaggcgagggcatggacgagatggagttcaccgaggctgacagcaacatgaacgacctcgtctctgagtatcagcagtaccaggatgccaccgcagaagaggaggaggatttcggtgaggaggccaaagaggaggcctaaggcagagcccccatcacctcaggcttctcagttcccttagccgtcttactcaactgcccgtttcctctccctcagaatttgtgtttgctgcctctatcttgttttttgttttttcttctggggagggtctagaacagtgcctggcacatagtaggcactcaataaatacttgtttgttg

SEQ ID NO: 3697 - DNA, 2124 bp, Homo sapiens
cctatccaggtgagaactggccactctaatttacccggaagcctttctgcaggagattcaaatatttgctaatgcttactgacaccttcactggttagatcgagacattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggattcacagttctgggaggtgatctctgatgaacatgccatcgactccgctggcacctaccacggggacagccacctgcagctggagcgcatcaacgtgtactacaacgaggccagcggtgagacccccgtccttcccccaccgccctcctgggaacgcggccctcccctcgctcatgccctcccgccccacgcaggtggcaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaataaagtattctcacagcat

SEQ ID NO: 3698 - DNA, 1944 bp, Homo sapiens; identical to SEQ ID NO: 3687

SEQ ID NO: 3699 - DNA, 1604 bp, Homo sapiens
gctcttctgctgctgtttgtctacttcctcctgcttccccgccgccgccgccgccatcatgagggaaatcgtgcacttgcaggccgggcagtgcggcaaccaaatcggcgccaagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtg

SEQ ID NO: 3700 - DNA, 1957 bp, Homo sapiens
cgctcttctgctgctgtttgtctacttcctcctgcttccccgccgccgccgccgccatcatgagggaaatcgtgcacttgcaggccgggcagtgcggcaaccaaatcggcgccaagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtgtggtttcgctttgcccattccttccagtaggccctccgggtgctgttgccgaatgtcagggcgtagttgtcctgcatggctgcggggagccaggctgcagctgagctgggcttatgtgcccaggaccagcatgggctggacacccaggcttcagagaagtgtggggctgccctgggccctgggtatctgcttggtggggaacttgcttgttgaaggcaggcctgtcctgttccaggtacccaaccttggggctcggcctgtgtctgggacttaggtgggtccagtgaccccccttccaaaaggggtagggaggatggcagacaatcctaccccaaccaaggtgggaccctggtaatggtcagacaggtggtcctgaaccagcaatgaagggtgagcaggtagagccgtccctccccacattggccggggtg

SEQ ID NO: 3701 - DNA, 2382 bp, Homo sapiens
agggctcgcggttactgcaaggattctggcgaatgaggtctaaatagaatgagaaggggggctgcggaccgagaaactgagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggat

SEQ ID NO: 3702 - DNA, 2377 bp, Homo sapiens
acctatccaggtgagaactggccactctaatttacccggaagcctttctgcaggagattcaaatatttgctaatgcttactgacaccttcactggttagatcgagacattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggattcacaggtgggtgcacctgtgtggaagtaaagctgttgcttattctgggagccgaatccgaggcggagggaggtgggcgcggggctatttaaacgttggcggagggcgggctgggtcgctgcgcatcagctcctccttctcacgtttctcctgccgtcctaatcccgccttggccatgagggagatcgtgctcacgcagatcgggcagtgcgggaatcagatcggcgccaagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaataaagtattctcacagcat

SEQ ID NO: 3703 - DNA, 2124 bp, Homo sapiens; identical to SEQ ID NO: 3697

SEQ ID NO: 3704 - DNA, 2505 bp, Homo sapiens; identical to SEQ ID NO: 3682

SEQ ID NO: 3705 - DNA, 2580 bp, Homo sapiens; identical to SEQ ID NO: 3694

SEQ ID NO: 3706 - DNA, 4608 bp, Homo sapiens
tcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcggggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 3707 - DNA, 4607 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcggggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatagatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatactattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttgagaaaatgtacacaataaaacattccttgcttgtta

SEQ ID NO: 3708 - DNA, 4608 bp, Homo sapiens; identical to SEQ ID NO: 3706

SEQ ID NO: 3709 - DNA, 3132 bp, Homo sapiens
gactggcagtccccggggccaatggcaagcggataaacagaggcggccgtggaagaggactggaggcgaggctccgcccctccacgggacagtcaggcgagatagccagtgagctcgcaccagaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccattcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatg

SEQ ID NO: 3710 - DNA, 3132 bp, Homo sapiens; identical to SEQ ID NO: 3709

SEQ ID NO: 3711 - DNA, 3132 bp, Homo sapiens; identical to SEQ ID NO: 3709

SEQ ID NO: 3712 - DNA, 3192 bp, Homo sapiens
cgccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 3713 - DNA, 3132 bp, Homo sapiens; identical to SEQ ID NO: 3709

SEQ ID NO: 3714 - DNA, 793 bp, Homo sapiens
tgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcagtaaaaaaaaaa

SEQ ID NO: 3715 - DNA, 1093 bp, Homo sapiens
aggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaata

SEQ ID NO: 3716 - DNA, 1093 bp, Homo sapiens; identical to SEQ ID NO: 3715

SEQ ID NO: 3717 - DNA, 777 bp, Homo sapiens
atgtcaaatgttcaaaatgttgatgtcgagagcccgcggcactggcagcttggcctgcgctgcgctgcgatgttagaggagtcagccaggagcccggggaagggaagcacgcccctggggctggtcccagagggcctgatctgcatctgcagcatgaggttctgcccgtttgctgagaggacgcatctggttctgaaggccgagggaatcaggcatgaagtaatctatatcaacctgaaagataagcctgagtggttctttaagaaaaatccctttagtttggtgccagttctggaaaacagtcagggtcagctgatctacgagtctgccatcacctgtgagtacctggatgaagcatactcagggaagaagctgttgccggatgacccctatgacaaagcttgccagaagatggtctttgagttgttttctaaggtgccatctttggtaggaagcttccttagaacccaaaataaggaagatggtgctggcctgaaagaagcattgtgtaaagaatttagcaagctagaggaggttctgattaataagaagacaaccttctttggtggcagttccatctctatgattgactacgtcatctggccctcgtttgaacggctggaagcaatgaagttaaatgagtgtgtagaacacactccagaacttaaactgtggatggcagccatgagggaagatcccacagtctcagccctgctcactggtgtgaaggactggcaaggtttcacagagctctacttacagcctggaggcctgtga

SEQ ID NO: 3718 - DNA, 964 bp, Homo sapiens
gagcttggggaagggtgaggcctgcccgccgcgaagagggggtgatctcggcgacccccggcggcatgttcgaggctgctccgggagcccagccgcccgggagcgccccaccggcggggaacgggtcggagctgcagtgggacgcgggggcggtgggatacggggggtctcgacacctctctgggccgtaatcgccttcgcttctccccggcaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaata

SEQ ID NO: 3719 - DNA, 1399 bp, Homo sapiens
atttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcaacccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaata

SEQ ID NO: 3720 - DNA, 1506 bp, Homo sapiens
atgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 3721 - DNA, 2302 bp, Homo sapiens
gtggccaggatcgggtctgggaagctcggagatttcactgtgagtggagtcagagggaaggcatttggagcaaaggcttctgtaagagggagtaggatggaaattgatctttgaagaaagcaagacagaagaagggagatggaaagatgaaatcattttaaaattgctggtaacaaacgaaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaatttttttaagtacaagttttggttacagtgatttcttcttgtcact

SEQ ID NO: 3722 - DNA, 2302 bp, Homo sapiens; identical to SEQ ID NO: 3721

SEQ ID NO: 3723 - DNA, 2116 bp, Homo sapiens
atcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgaaaaaaaaaaaaaaaaaaaaa

SEQ ID NO: 3724 - DNA, 2302 bp, Homo sapiens; identical to SEQ ID NO: 3721

SEQ ID NO: 3725 - DNA, 7515 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcacgaggagcagcaggtgcccatcctggagaagttttgcttcactccccacacggaggaggggtgcctgtctgagcacgctgccctcgaggaggagctgcaactgtgcaaggggctggtcgaggcactcgagaccaaggtgacccagcaggggctgaagatggtggtgccggactggacggggcccagatccccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgcggacctcctggtgtgcaactgtgctgtggctgccctcggggacccggcctcagctctcagcaacatggtggctgccctgagagaagggggctttctgctcctgcacacactgctccgggggcaccctcgggacatcgtggccttcctcacctccactgagccgcagtatggccagggcatcctgagccaggacgcgtgggagagcctcttctccagggtgtcgctgcgcctggtgggcctgaagaagtccttctacggcgccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaaccgtccggtgtgtgctgctctccaacctcagcagcacctcccacgtcccggaggtggacccgggctccgcagaactgcagaaggtgttgcagggagacctggtgatgaacgtctaccgcgacggggcctggggggttttccgccacttcctgctggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttcggtacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtcgaggccgccatccgggatggggtggtacggcccctcaagtgcacggtgttccatggggcccaggtggaggacgccttccgctacatggcccaagggaagcacattggcaaagtcgtcgtgcaggtgcttgcggaggagccggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccaggggctacaggtgcaggtgtccaccagcaacatcagctcactggagggggcccggggcctcattgccgaggcggcgcagcttgggcccgtggggggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcaccgtgggcattttggtggagacgatgagcaccaacgacacgatcgtcagtggcacgctgcccacgcgcattggcgtccttggcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctgggcggctcactggcggacctgggcctggactcgctcatgagcgcgccggtgcgccagacgctggagcgtgagctcaacctggtgctgtccgtgcgcgaggtgcggcaactcacgctccggaaactgcaggagctgtcctcaaaggcggatgaagccagcgagctggcatgccccacgcccaaggaggatggtctggcccagcagcagactcagctgaacctgcgctccctgctggtgaaaccggagggccccaccctgatgcggctcaactccgtgcagagctcggagcggcccctgttcctggtgcacccaatcgaggctaccaccgtgttccacagcctcggtcccggtctcagcatccccacctatggcctgcagtgcaccccggctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtaaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaggctgcgtgccgctgaccagtatacacccaaggccaagtacagtggcaacgtgatgctactgcgggccaagacgggtggccgctacggcgaggacctgggcgcggactacaacctctcccaggtatgcgacgggaaagtatccgtccatatcatcgagggtgaccaccgcacgctgctggagggcagcggcctggagtccatcatcagcatcatccacagctccctggctgagccacgtgtgagtcgggagggctag

SEQ ID NO: 3726 - DNA, 8230 bp, Homo sapiens
ccgcccgccctgcagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccaaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggaacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccacc

SEQ ID NO: 3727 - DNA, 8481 bp, Homo sapiens
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaaaaaaaaaaaaaaaaaaa

SEQ ID NO: 3728 - DNA, 5757 bp, Homo sapiens; identical to SEQ ID NO: 3534

SEQ ID NO: 3729 - DNA, 4152 bp, Homo sapiens
ggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaat

SEQ ID NO: 3730 - DNA, 3776 bp, Homo sapiens
gcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtc

SEQ ID NO: 3731 - DNA, 4152 bp, Homo sapiens; identical to SEQ ID NO: 3729

SEQ ID NO: 3732 - DNA, 3565 bp, Homo sapiens
cccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggtcctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatcccaaaaaaaaaaaaaaaaaaaaaa

SEQ ID NO: 3733 - DNA, 3573 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatccc

SEQ ID NO: 3734 - DNA, 3381 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatccc

SEQ ID NO: 3735 - DNA, 3778 bp, Homo sapiens
gccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaattttttgatgagtttttacttttacctctctactcttgattttctattattgaatactatctttttttcatgaactatcagaatatagtgaacacttttcaaatatttaaggacttaa

SEQ ID NO: 3736 - DNA, 1610 bp, Homo sapiens
ggcacgaggctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtgggcggccgcctgcctgcccgcccgcccgcagccccttgcctgccggcccctgggcggcccgtgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatac

SEQ ID NO: 3737 - DNA, 4971 bp, Homo sapiens
gccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaattttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaacatccaaatcataaag

SEQ ID NO: 3738 - DNA, 3778 bp, Homo sapiens; identical to SEQ ID NO: 3735

SEQ ID NO: 3739 - DNA, 4971 bp, Homo sapiens; identical to SEQ ID NO: 3737

SEQ ID NO: 3740 - DNA, 1690 bp, Homo sapiens
gatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcgtaagtctgtgggcaaggtgatcagctggtttgcccagaacctttctggttttagcactcaaagtctcacatctggaatctcttcagtcacagctcaatgagatgaatggtcacccttgtgggggatattcatcctggtatcttgctctagaagatgaaacaaccactttggaatgacagaagggaagcattttactcacggacacattctgtattctccacctcgcggtcattactctatctaagccagtcatttctgggtgtgttgactccaatgctctcatagtgctttggaagtggcttggatatgtgtggcattggtatatcagggactgtcaccacttaactagaggaacttctgcaaacagtgagatcaaacaaacatcttcctcccactctggaattcattcattcatttattaacttattcaataaacatgaattgaggatctactgtatgctggatcctcttgttagcactgaggctgcaaggccaaaggaggcagctttgccttcagagagtaagcctagtgacttacgggacagacgaggaggaaagtcaccctcacagtaagccaacagcccatcaaaggggcttgcatcctaggagctgattggcattcctccaaaaagcactgttgttttttcagaggatcctcagccaagctgtcagagtcatctctgggctttgcttatgtagggaaggacgttcttatgttccccaacttgtgatttatacatctttgaccaggaggcccaggcatttcaatactaattatagttcttcaacatgtcagtgaagtctgtctttagcaaaagcaagaggagggcaggtgcagtggttcacgcctgtaatgccagcactttgggagtccgaggagggtggctcacctgaggtcaggagttcgagaccagcctgaccaacatggagaaactccgtctctactaaaaatataaaatcagctgggcatggtggcgcatgcctctaatcccagccaattgggaggctgaggcaagagaatcacttgaacccgggaggcggaggttgcagtgagctgagatcgcaccattgcactccagcctgggcaacaagagtgaaactccatctc

SEQ ID NO: 3741 - DNA, 1145 bp, Homo sapiens
tcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttctcgtgc

SEQ ID NO: 3742 - DNA, 1309 bp, Homo sapiens
gatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcacccat

SEQ ID NO: 3743 - DNA, 4408 bp, Homo sapiens
cctggcctcgcgggccgtgtctccggcatcatgtgtggtatatttgcttacttaaactaccatgttcctcgaacgagacgagaaattcctggagaccctaatcaaaggcctcagagactggagtacagagctcatgatggtttaggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttac

SEQ ID NO: 3744 - DNA, 2004 bp, Homo sapiens
tgaaagtgggcacagctgctgcacatcccggggctcctgacctctctgcgtttgcagcgtagcccaagtcggtcagcactggaggacctcagaagccatgttgaagccccatagtgaagccagggctgccttcattcagacccagcagctgcacgcagccatggctgacacattcttggagcacatgtgctgcctggacactgactcgccacccatcacagcctggagcactggcatcatccgtactatgggcccagcttctccattgctagagatgctgaagaaaacgattaagtctggaattaatgtggctcatctgaactctcatggagcccatgagtaccatacagagaccatcaagaacgtgcgcacagccacggaaagctttgcttctgactccatcctctaccagcccattgctgtggctccagacactaaaggacctgagatcccaactgggcccgtcaagggcagcggcactgcagaggtggagctgaagaagggagccactctcaagttcacgctggataatacctacatggaaaagggtaagagaacatcctgtggcgggactacaagaacatctgcaaggtggtggaagtgggctgcaagatctacgtggatgatgggctaatttctctccaagtgaagcagaaggatgctcactttctggtgacagaggtggaaaatggtggctccttgggcagcaagaagagtgtgaaccttcctggggctgccgtggacctgcctgccatgttggagaaggacatccaggacctgaagtttgggggcgagcaagatgtcgatatgatgttttcatcattcatctgcaagacatctgatgtccatgaagttaggaaggtcttgggagagaaaggaaagaacagcaagataaccagcaaaattgagaatcatgatgggggttggaggtttgatgaaatcctggaggccagcgatgggattatggtagctcgtggtgatccaccacaagccgtcgagatgagattcctgcagggaaggtctgccttgctcagaggatgatgattgggtggtgcaaccaagctgggaagcctgtcatcttgccactcagatgctagaggatgtgatcaagaagctccaccccacttgggctgagggcagtggtgtggccaatgcagttctggtggaagctgactgcatcatgctgtctggagaaacagccaaagggaactatcctctggaggctgtgcacatgcagcacctgattgcctgtgaggcagaggccaccatctaccacttgcaattatttgaggagttctgccacctggcacccattaccagtgaccccgcagaagctactgccgtgggcactgtggaggcctccttcaagtgctgcagtggggccataatcgtcctcaccaagtctgcaggtgtgcccaccaggtggccagatactgcccacgtgcccccatgattgttgtgacatggcatccccaggcagctcgccaggcccacctgtaccgtggtatcttccctgtgctgtgtaaggaccccatccaggagccctaggctgaggatgtggacctccgagtgaacttggccatgaatgttggtaaggcctgaggcttcttcaagaaggatgatgtggtcattgtgctgacctggtgacaccctggccctggcttctccaccaccctgtgtgttattcctgtgctgtgatggactccagagctcttcctccagcccctgtcccacccccttcccccaatgcatccattaggccagcaatgcttatagagctcactctgggctgtagtgtggcactggtgggctggaacaccagggaagaagatttatgcctcgctgaaacgtggctgtttttagagcctgctgtggcgggagagcccggagcctggctgcccatcatgtggccccacccaagcaagagaagaaggaggaatgcagaacagaggcccccagagtgtatggcaagagggtggcagcttcctttcttctgtgtactct

SEQ ID NO: 3745 - DNA, 2117 bp, Homo sapiens
ggcagtggctccttgcacagcagctgcacgcgccgtggctccggatctcttcgtctttgcagcgtagcccgagtcggtcagcgccggaggtgagcgccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcagtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccatggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaccgactctggccctggcccttacttgcttctctagctctctaggcctctccagtttgcacctgtccccaccctccactcagctgtcctgcagcaaacactccaccctccaccttccattttcccccactactgcag

SEQ ID NO: 3746 - DNA, 2837 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggctacatga

SEQ ID NO: 3747 - DNA, 2846 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccaccctgagccatccgttgccttcatgttgatgtctttccccacccaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggctacatga

SEQ ID NO: 3748 - DNA, 2841 bp, Homo sapiens
gttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggcaagtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggctacatga

SEQ ID NO: 3749 - DNA, 2643 bp, Homo sapiens
ccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgatactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctacaatgtctctagaaaacatagcttcttactgaacttgaacat

SEQ ID NO: 3750 - DNA, 4780 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggttggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaagatttgtttggctgactggcagtaacctagtgaatttctgaaagatgagtaatttctttggcaaccttcctcctcccttactgaac

SEQ ID NO: 3751 - DNA, 7886 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaa

SEQ ID NO: 3752 - DNA, 2087 bp, Homo sapiens
ggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacgcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaagttaatta

SEQ ID NO: 3753 - DNA, 2178 bp, Homo sapiens
agacgggagggtcctcggctaaagcccaaagcggatcaaagtggtgggactcgcgccgcggccgcggagacgtgaaggccgtccgcacgcctcctcgcgatccgggtcggtgctcgccctcgctctcctctccgcgtccccatggagaagacggagctgatccagaaggcgaagctggccgagcaggccgagcgctacgacgacatggccacctgcatgaaggccgtgacggagcagggcgccgagctgtccaacgaggagcgcaacctgctctcggtggcctacaagaacgtggtcgggggccgcaggtccgcctggcgggtcatctcgagcatcgagcagaaaaccgacacctcggacaagaagttgcagctgattaaggactatcgggagaaagtggagtccgagctgaggtccatctgcaccacggtgctggaattgttggataagtatttaatagccaacgcaactaatccagagagtaaggtcttctatctgaaaatgaagggagattattttcggtaccttgctgaagttgcgtgtggtgatgatcgaaaacaaacgatagataattcccaaggagcttaccaagaggcttttgatataagcaagaaagagatgcaacctacacaccccattcgcctggggctggctcttaacttttctgtattttactacgagatccttaataacccagagcttgcctgcactctggctaaaacagcttttgatgaggccattgcagaacttgatacactgaatgaagattcatacaaagacagcaccctcatcatgcaattgcttagagacaacctaacattatggacatcagacagtgcaggagaagaatgtgatgcagcagaaggggcagaaaactaaatgcatacagggtggtcatccttcccctcgagaaacctttttactcatctccattccttattccatttggatttcctatagcaaagaaacccattcatgtgtatggaatcaactgtttatagtcttttcacaccacagctttgggaaaactccattccttgatttgtgtttgtcttggccttcctggtgtgcagttactgctgtagaaaagtattaatagcttcatttcatataaacataagtaacttccaaacacttatgtagaggactaaaaatgtatctggtatttaagtaatctgaaccagttctgcaagtgactgtgttttgtattactgtgaagatatgaaatgtagtcattacaatttaaaagtgttccacataacttcttaatttctacattccctcccctactcttcttcaggggtttcctttcagtaagcaacttttcatgctcgtaatgtattcctttttggtaggaatccagaagtattagattgagtggaaagcgtttggcatttctgcgctgggggtcacaaattgaaatgcctcccgtatcatatatgatggaggtcttgtgtatctgtgacaacaggaagtttccttactcattcttcatttgctgctgtttaagttgacaacttcccttcccaataaaaattcacttacacctactgcctttgtagttctggtattcactttactatgtaatagaagtagcatgttgctgccagaatacaagcattgcttttggcaaattaaagtgcatgtcatttcttactacactagaaaggggaaataaagtacacaagtccaagtctaaaacgttagtacttttccatgcagatgtgtacacatgtgagagggtgtccagtttgtctagtgattgtcatgtagagagttggaccactattgtgtgttgctaatcattgactgtagtcccaaaaaagccttgtgaaaatgttatgccctatgtaacagcagagtaacataaaataaaactacattttataaaccatttactatggctttgtaacaatggcacactcgttttaagggacagatgaatttactactttctgaagtttactgatacttcccttttatcttatgtaaattgtagtgatacctgtacctgcattgtgattgacttgtctagggatgcctggaaatgtataaaattggactacatgtcttagagttagtattttaccatagatcagttatgtgggccatctcttcttcagatgtaaatgatacctagttaagtgttatatggaataaagtggacattttgaaatt

SEQ ID NO: 3754 - DNA, 1824 bp, Homo sapiens
ggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttata

SEQ ID NO: 3755 - DNA, 2142 bp, Homo sapiens
ctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaagttaatta

SEQ ID NO: 3756 - DNA, 1885 bp, Homo sapiens
gcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattaaaaaaaaaaaaaaaaaaaaaaaaaaaaaaaaaaaaaaa

SEQ ID NO: 3757 - DNA, 3393 bp, Homo sapiens
cgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatctagtaaagtggggtttatttatatagtggttaagaaatgtcagtttacactgctgtat

SEQ ID NO: 3758 - DNA, 5508 bp, Homo sapiens
cgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaaggtaaattacttatagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaatttttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattc

SEQ ID NO: 3759 - DNA, 2530 bp, Homo sapiens
gggagagtaaatcagtaaggctccacccatttcacaggaggcctagagaccggcgctcccctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctaca

SEQ ID NO: 3760 - DNA, 2123 bp, Homo sapiens
atgagtgattttgaagaatggatttctgggacatatagaaaaatggaagaaggtcctctccctctgttgacttttgctacagctccctaccacgatcagaaaccaggaacaagtggattacggaagaaaacctattattttgaggaaaagccatgctatctggagaatttcatccagagtatattcttttccatagacctaaaagatcgccagggatcatcactggtggttggtggagatgggcggtactttaataaatcagcaatagaaacaatagtgcagatggcagctgccaatgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaa

SEQ ID NO: 3761 - DNA, 2487 bp, Homo sapiens
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaaaaaaaaaaaaaaaaa

SEQ ID NO: 3762 - DNA, 2487 bp, Homo sapiens; identical to SEQ ID NO: 3761

SEQ ID NO: 3763 - DNA, 1857 bp, Homo sapiens; identical to SEQ ID NO: 3192

SEQ ID NO: 3764 - DNA, 1553 bp, Homo sapiens; identical to SEQ ID NO: 3198

SEQ ID NO: 3765 - DNA, 1381 bp, Homo sapiens; identical to SEQ ID NO: 3191

SEQ ID NO: 3766 - DNA, 991 bp, Homo sapiens
atgttaaaagctatttttcaaggctggcacagtcttacctgcatttcaaaccacagtaaaagtcgattctccttctctagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaatttctattgacccacaaagtttcagaaattctctgaaagtttcttccttttttctcttactatatt

SEQ ID NO: 3767 - DNA, 1381 bp, Homo sapiens; identical to SEQ ID NO: 3191

SEQ ID NO: 3768 - DNA, 993 bp, Homo sapiens
gccatggcgacctccaggaagttcgttggggggaactggaagatgaaccgacggaagaagagcctgggggagctcatccgcactctgaaggcggccaaggtgccggccaacactgaggtggtttgcactctccccactgcctatatcgactttgccccagaagctagagcccaagattgctgtggctgcgcagaactgctacaaagtaactaacggggcctttacttgggagatcagccctggcatgatcaaagactgcaaagccaatcgagggtcctggggcactcagagagtaggcatgtctttggggagtcagataagctgattgggcagaaagtggcccatgctctggcaaagggactcagagtaatcgcttgcactggggagaagctagctgaaagggaagtggcatcactgagaagtttgttttcgagaagaaagaggtcatcgcagataacgtgaaggactggagcaaggtcgtcctggcctgcgagcctgtgtgggccattggtaccagcaagactgcaacaccccagaaggcccaggaagtacacgagaagttctgagaatggtgtccaacatctctgatgtggtggctcagagcacccgtatccatttatggaggctctgtgatgggggcaacctgcaaggagctggccagccagcctgaagtggatggcttcctcgtgggtgatgcttccctcaagccctaattcgtggacatcatcaatgccaaacaatgagccccatccatcttccctacccttcctgccaagccagggactaagcagcccagaagcccagtaactgcccctcccctgcacatgtttctgatggtgtcatctgccccctcttgcggcctcatccaaactgtaccttcctttactgtttatatcttcaccctgtaatggttgggaccaggccactcccttctccacttagtataatcgttggaactagacgtcaccaaggtggcttctccttggctgagag

SEQ ID NO: 3769 - DNA, 2930 bp, Homo sapiens; identical to SEQ ID NO: 3677

SEQ ID NO: 3770 - DNA, 2288 bp, Homo sapiens
ccctgcacttgggagccggtagcactcctatcactgcttctcaacccgtgagctaccagctgtgtcatgagctgcagacagttctcctcgtcctacttgagccgcagcggcgggggtggcgggggcggcctgggcagcgggggcagcataaggtcttcctacagccgcttcagctcctcagggggcggtggaggagggggccgattcagctcttctagtggctatggtgggggaagctctcgtgtctgtgggaggggaggcggtggcagttttggctacagctacggcggaggatctgggggtggttttagtgccagtagtttaggcggtggctttgggggtggttccagaggttttggtggtgcttctggaggaggctatagtagttctgggggttttggaggtggctttggtggtggttctggaggtggctttggtggtggctatgggagtgggtttggggggtttgggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggtgctggaaaaattggccttggaggtcgaggaggaagtggaggcagttatggaagagggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagccccagctgagcatccccagatgggcagactcccgatgaagcctgcttattggatcctgacatcaggaatagctggcaacaagcccctgtgcccgtttgggactgaactgacttggcatatgtgcctctggctttccattggcttccaaccctgcttggctttgatgccttcagggttggggagacagacctctttcctctctctggcctggggtgctctcacaccctgcacgatcttgactataataaagcttccctactgc

SEQ ID NO: 3771 - DNA, 2352 bp, Homo sapiens
ccctgcacttgggagccggtagcactcctatcactgcttctcaacccgtgagctaccagctgtgtcatgagctgcagacagttctcctcgtcctacttgaccagcggcgggggtggcgggggcggcctgggcagcgggggcagcataaggtcttcctacagccgcttcagctcctcagggggccgtggaggagggggccgattcagctcttctagtggctatggtgggggaagctctcgtgtctgtgggaggggaggcggtggcagttttggctacagctacggcggaggatctgggggtggttttagtgccagtagtttaggcggtggctttgggggtggttccagaggttttggtggtgcttctggaggaggctatagtagttctgggggttttggaggtggctttggtggtggttctggaggtggctttggtggtggctatgggagtgggtttggggggttagggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagcccccagctgagcatccccagatgggcagactcccgatgaagcctgcttattggatcctgacatcaggaatagctggcaacaagcccctgtgcccgtttgggactgaactgacttggcatatgtgctctggctttccattggcttccaaccctgcttggctttggatgccttcagggttcccgagacagacctctttcctctctctggcctgggagctctcacaccctgcacgatcttgactataataaagcttccctactgcaaaaaaaaaaaaaaaaaaaaaaaaaaaaaaaaaaaaaaaaaaaaaaaaaaaaaaaaaaaaaaaaaaaa

SEQ ID NO: 3772 - DNA, 2217 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagatgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccc

SEQ ID NO: 3773 - DNA, 1516 bp, Homo sapiens
tgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaaaaaaaaaaaaaaaaaaaaaaaaaaaaaaaaaaaaaaaaaaaaaaaaaa

SEQ ID NO: 3774 - DNA, 1571 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagatatc

SEQ ID NO: 3775 - DNA, 1571 bp, Homo sapiens; identical to SEQ ID NO: 3774

SEQ ID NO: 3776 - DNA, 1628 bp, Homo sapiens
ccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagatatc

SEQ ID NO: 3777 - DNA, 3396 bp, Homo sapiens
cagaacactgcgtgtcctgtgcgcgcgtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaa

SEQ ID NO: 3778 - DNA, 3396 bp, Homo sapiens
cagaacactgcgtgtcctgtgcgcgcgtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagcatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaa

SEQ ID NO: 3779 - DNA, 1619 bp, Homo sapiens
cagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacag

SEQ ID NO: 3780 - DNA, 3396 bp, Homo sapiens; identical to SEQ ID NO: 3777

SEQ ID NO: 3781 - DNA, 3689 bp, Homo sapiens
atttagtccgcaacacctcgctccccaggaggtctgccagcctggactggaagcgtgcaacactccagagtcgtaggagtgaacactgcacaggaatctctgcccatctcaggagaaaccaaacctggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagattcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaaataggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaataaaaaaaaag

SEQ ID NO: 3782 - DNA, 3637 bp, Homo sapiens
tggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaat

SEQ ID NO: 3783 - DNA, 2720 bp, Homo sapiens
gagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgctaagggc

SEQ ID NO: 3784 - DNA, 2664 bp, Homo sapiens
gagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaaggtgaccaggttttccagggggcaaatggggggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggtaagtgaccctatcataaaagacatcagcaccagaggcagagcagaaaaacactagcatttcaagactaaacattgaagaacactgctctttttagtatcatttcttccaagttcacaggatctgaaatcaggaggctcctctctgaaaagctgggtcaaaggaagagagacactgacccaggcaaggcccatattgcctgagctggagtcatcttaaacccagaggttgcctggcagcctcactattctgggttggtggatcccagaaaacatgggcagaaagggctaaatctggtttccctccaatacatttgtgatttaagacctgacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccggctacttgggaggctgaggcaggagaatggcgtgaacccgggaggcggagcttgcagtgagccgag

SEQ ID NO: 3785 - DNA, 1508 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 3786 - DNA, 1350 bp, Homo sapiens
ggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 3787 - DNA, 1359 bp, Homo sapiens
ggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 3788 - DNA, 1436 bp, Homo sapiens
ggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 3789 - DNA, 1296 bp, Homo sapiens
cggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttttaaaaaaaaaaaaaaaaaaa

SEQ ID NO: 3790 - DNA, 1436 bp, Homo sapiens; identical to SEQ ID NO: 3788

SEQ ID NO: 3791 - DNA, 3944 bp, Homo sapiens
ccatcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaac

SEQ ID NO: 3792 - DNA, 3944 bp, Homo sapiens; identical to SEQ ID NO: 3791

SEQ ID NO: 3793 - DNA, 3974 bp, Homo sapiens
ccatcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaac

SEQ ID NO: 3794 - DNA, 3974 bp, Homo sapiens; identical to SEQ ID NO: 3793

SEQ ID NO: 3795 - DNA, 2081 bp, Homo sapiens; identical to SEQ ID NO: 3436

SEQ ID NO: 3796 - DNA, 3600 bp, Homo sapiens
gcgggggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgagcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcaggttttcagttggtcaacacaattatgagagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacctagataccgaaaagggcctgatgtctgctttgataacaatgtcttggaggattatactgactgtggtggtgtttctggattaaatccctccctgtggtatatcattggaatccagtttctactactttggctggtatctggcagcacacaccggctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggcgtttgttgttgcattgttggt

SEQ ID NO: 3797 - DNA, 4009 bp, Homo sapiens
gtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatgggg

SEQ ID NO: 3798 - DNA, 3822 bp, Homo sapiens
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 3799 - DNA, 916 bp, Homo sapiens
gcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgta

SEQ ID NO: 3800 - DNA, 844 bp, Homo sapiens
gtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtgggttctataagttgtaccaaaacatccacttaagttctttgatttgtaccattccttcaaataaagaaatttggtaccc

SEQ ID NO: 3801 - DNA, 1540 bp, Homo sapiens
cgcggctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaagtagtctgggatttttatctattaagctaaccatttgattcaggctgttgtaggacatgttcttcagtgtggacagctgtatggctgtgactggatcagtgtcctgctggtgtacacacaggtgaggacctggctggcgaagcatccccattaggaagcaggttaggaatgtgcttcatccctagtgagaatgaaagtattaacagcataagtatggaaggtaccttcatttcaaataccaaaatgttgcagtaggagggcaaaggttgagacgatccttttttttttttttttgagacagtct

SEQ ID NO: 3802 - DNA, 1540 bp, Homo sapiens; identical to SEQ ID NO: 3801

SEQ ID NO: 3803 - DNA, 1540 bp, Homo sapiens; identical to SEQ ID NO: 3801

SEQ ID NO: 3804 - DNA, 741 bp, Homo sapiens
cgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccaggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccca

SEQ ID NO: 3805 - DNA, 833 bp, Homo sapiens
ccagccctccgtcacgtcttcactgcaccctcagaccaccccaaggcccccaccgccgctccagcgccacgcagccaccgccgccgcagcctctccttagtcattgccatgatgactgcatccaactcgcaggtgcgccagaactaccaccaggactcagaggccgccatcaaccgccagatcaacctggagctctacgcctcctactttaacctctccatgtcttactactttgaccgtgatgatgcggctttgaagaactttgccaaatactttcttcaccaatctcatgaggagagggagcatgctgagaaactgatgaaactgcagaaccaacaaggtggctgaattttccttcaggatatcaagaaaccagactgatgactgggatagtgggctgaatgtgatagagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaacgtgaccaacttgcacaagatgggagcacccgaatctggcttggcagaatatctctttgacaagcacaccctgggagaaagtgataatgaaagctaagcctcaggctaatttccccatagctgtggggtgacttccctggtcaccaaggcagtgcatgcatgttggggtttcctttaccttttctataagttgtaccaaaacatccacttaagttcttttgatttgtaccattccttcaaataaagaaatctggtaccccccccccaaaaaaga

SEQ ID NO: 3806 - DNA, 920 bp, Homo sapiens
ttcagagacgttcttcgccgagagtcgtcgaggtttcctgcttcaactgtgcttggacggaacccggcgctcgtcccccaccccggccggccacccatagccagccctccgtcaccttttcaccgcgccctcggactgccccaaggtccccgccgccgctccagggccgcgcagccaccgccgccgcctctccttagtcgccgccttgacgaccgcgtccacctcgcaggtgcgccagaactaccaccaggactcagaggcggccatcaaccgccagatcaacctggagctctacgcctcctacgtttacctgtccatgtcttactactttgaccacgatgatgtggctttgaagaactttgccaaatactttcttcaccaatctcatgaggagagggaacatgctgaggaactgatgaagctgcagaaccaatgaggtggccgaatcttccttcaggatatcaagaaaccagactgtgatgactgggagcgggctgaatgagatggagtgtgcattacatttggaaaaaaatgtgaatcagtcaccactggaactgcacaaactggccactgacaaaaatgacccccatttgtgtgacttcattgagacacattacctgaatgagcaggtgaaagccatcaaagaattgggtgaccacgtgaccaacttgcacaagatgggagcgcccgaatctggcttggcggaatatctcttcgacaagcacaccccggggagacagtgacaatgaaaggtaagcctcaggctaatttccccatagccgtgggttgacttccctggtcaccaaggcagtgcatgcatgttggggtttcctttaccttttctataaattgtaccaaaacatccacttaagttctttgatttgtaccattcctgcaaataaagaaatttggtacccccc

SEQ ID NO: 3807 - DNA, 869 bp, Homo sapiens
ccagacgttcctcgccgggagtcgtcggggtttcctgcttcaacagtgcttggacggaacccggcgttcgtcccccatcccggccggccgcccatagccagtcctccgtcaccacttcaccgcgccctcggtaccgccccaaggcccgccgccgctccagcgccgcgcagccaccgccgcctctccttagccgccgccgtgacgaccgcgtccacctcgcaggtgcgccagagctaccaccaggactcagaggccgtcatcaaccgctagatcaacctggagctctacgcctcctacgtttacctgtccatgtcttactactttgaccgcgatgatgtggctttgaagaactttgccaaatactttcttcaccaatctcatgaggagagggaacatgccgagaaactgatgacgttgcagaaccaacgaggtggccgaatcttccttcaggatatcaagaaaccagactgtgacgactgggagagcgggctgaatgcgatggagtgtgcattacatttggggaaaaaaaaatatgagtcagtcactactggaactgcacaaactggccagtgacaaaaatgacccccatttgtgtgacttcattgagacacattacctgaatgagcaggtgaaagccatcaaagaattgggtggccacgtgaccaacttgtgcaagatgggagcacccgaatctggctcggcagaatatctctttgacaagcacacgctgggagacagtgataacgaaagctaagcctcaggctaatttccccatagccatggggtgacttccctggtcaccaaggcagtgcatgcatgttggggtttcctttactttttctataagttgcaccacaacatccagaaaa

SEQ ID NO: 3808 - DNA, 1540 bp, Homo sapiens; identical to SEQ ID NO: 3801

SEQ ID NO: 3809 - DNA, 1135 bp, Homo sapiens
atgactgcatccaactcgcaggtgcgccagaactaccaccaggactcagaggccgccatcaaccgccagatcaacctggagctctacgcctcctactttaacctctccatgtcttactactttgaccgtgatgatgcggctttgaagaactttgccaaatactttcttcaccaatctcatgaggagagggagcatgctgagaaactgatgaaactgcagaaccaacaagagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaacgtgaccaacttgcacaagatgggagcacccgaatctggcttggcagaatatctctttgacaagcacaccctgggagaaagagggagcactggaatgtttaattcggacaatgccaatacaagtttacagagaagagagaactttccattgggttttgaaggttctgctgattttcaatgggcagaggtggaggaacagtctgagcagagagaacatcataaacaaaggagtgaatgtgagaaaggcttcaggtcccatcagagtactggcttcactttgactgtagaagatttagttgaagcagtattcaaaagtgtagaacttgtcaagctacctatccagtcctcttgtcttctgaaacagtggttacctgctctggaaaaccttctctctccatcctccaaagctcctggggtacagctttatcagcgcacctatcacactgattctggtctccaaaaactcttcttgctgaaaacagcatacaaaatactttccctcttcaaagcccaatacaacactggaaaagcaatggagaagaaagtactcagtatcttttccccactaaaagttgtactgcaatgcttgaacacaactggaggagccctaggtttatcaaaagtatctgccatttctaaaagaatgtgtttccaaggcatccagaaagagctctttccaactgcaccaaattccatttgctttccacaccctgtcccgacaaggggtgctgcagaagcacaaagccagccagatgca

SEQ ID NO: 3810 - DNA, 1540 bp, Homo sapiens; identical to SEQ ID NO: 3801

SEQ ID NO: 3811 - DNA, 1540 bp, Homo sapiens; identical to SEQ ID NO: 3801

SEQ ID NO: 3812 - DNA, 1540 bp, Homo sapiens; identical to SEQ ID NO: 3801

SEQ ID NO: 3813 - DNA, 758 bp, Homo sapiens
ttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatt

SEQ ID NO: 3814 - DNA, 725 bp, Homo sapiens
tcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgacttccctggtcaccaaggcagtgcatgcatgttggggtttcctttaccttttctataagttgtaccaaaacatccacttaagttct

SEQ ID NO: 3815 - DNA, 1540 bp, Homo sapiens; identical to SEQ ID NO: 3801

SEQ ID NO: 3816 - DNA, 708 bp, Homo sapiens
gctccagcgccgcgcagccaccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcggatcccccaatcactagacggccgcctgcaggtcgaccatagggagagctg

SEQ ID NO: 3817 - DNA, 1540 bp, Homo sapiens; identical to SEQ ID NO: 3801

SEQ ID NO: 3818 - DNA, 1245 bp, Homo sapiens
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaaaaaaaaaaaaaaaaaa

SEQ ID NO: 3819 - DNA, 6755 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatctatggctctttgttattatagaatgtctacataggtatttatttgcctttcttcctatcaatcagatttatttattttaaaagcccttgataagtagtaaaatatttaactgcttttcttaaccatacaagtcagaattagattttaaaattctatgaaaaattttaggataacaaatctaactagagacttaatgatttgtgttaggattctgtgagccatacttcagcttattattgttctcagcaatccccagatttgattgtctgttctaccagagtaagcttaaccagttttattatctaaaatgcttaataagtgccccctccccgccaagtgatgatggaattgaggatttattctttaaaaatacctataactccaagtttctttgactagcctccttaagttcatactactactttcagcgtacttggaaaaatcacaggaagaactaatctcttagaaaacatataacaagtgactgttaacacagagccagatatgtttacaagaattctaggatgtgtgtggctggggcagcggagacccaagcagaggctgggaggttggactagccctttccagtgctgctactctgtaaaatgtatgtctcaatcagactcacaggcccccatcccaaatactcaagacatcttaaccatttatcttgtaagatttcaagtttgatagttacttaacagtaattactaaattttagccagttaaattcttgtttggatgtgctcttttagctcaaaaaacagatttgtttttctttttatatccctgaaggacatactcctcaactttgcatgattactatagttggcttcttaaggggaagtgaagaaacaaacttctgtatcacaatgacttactatgaataataattgtgatccatgacagatacccataattacactgtatggctacattctaaaaatataccacaataaatacttggtatttgtagagctcaaagcactcttttacagagttttggttagtttggttttttcttttttttttttttttcgagacagggtcttgctatattgcccagaatggcctcaaactcctgggctcaagcgatcctcctccagcctcccgagtagctatagtttggttttaatcagtaaatatttatttagcacttggactgctctaggcactatagggtacaaaattagttgtattttatcctctcatcccagctgtgaggtaggtttgctaaagctgtaataccactaagcagttttttcaatactgttcccaaggacagataatattagcaaatcccagaagcatttctaaacacttgtaggaaaaataaagtcggacttaaaatttttagtatctttgccttttttttttttttttttttacataagttttacaagataatacatttttacagtgacctgatgtggatacaactttgcaacttggcaaaaagcaaatcttaacttacattataattaatttgctgcattttacacatctctgattctcaattttggcaagtacaacaggttaagggttctatttagtgtccccttctgatgaatatgatgatcttgaacccattcttcctcctcaagcacggtcatcctcctctgatggcaacagcagaacctctgggaaaggaacctttcggtatccagaactcccaggtggcagcccagtgtgggatttggagcatgacaacaaaggcattttctcaacatttactaaaggagagtggggtgttctatacgctactgatggggactgtacatgaacacatttaaattgaattacaacaacattttagataggaaatatagaatcttataagaacataatctaaattataaccaattttaaatagcaaagtttaacaataaagctacttaagtgtttgaattagaaataaacagtaaaacatctgtattaattataacagagttgacatttgtttatattttatcttcagtattaaccaaaggagtggaatttagccagggttgcactttttaaaagttgtatatacttttatttattttacaaaaggaaaaaaaaagacatacttttcccataaaattccaggtcttactatgtaaaataaccatgcactacttcatgttataatcataattttagactat

SEQ ID NO: 3820 - DNA, 3549 bp, Homo sapiens
ggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaata

SEQ ID NO: 3821 - DNA, 5675 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3822 - DNA, 5634 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacaattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagagctactcttaggccagatagcctgagcagacagacatgatgtgagttgtccaaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3823 - DNA, 5879 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3824 - DNA, 5528 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacaattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3825 - DNA, 5507 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3826 - DNA, 5681 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3827 - DNA, 5705 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3828 - DNA, 5834 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3829 - DNA, 5723 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaaaaaaaaaaa

SEQ ID NO: 3830 - DNA, 5696 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacaattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3831 - DNA, 5546 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3832 - DNA, 5811 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagagctactcttaggccagatagcctgagcagacagacatgatgtgagttgtccaaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3833 - DNA, 5789 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3834 - DNA, 5591 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3835 - DNA, 5744 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3836 - DNA, 5552 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3837 - DNA, 5720 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3838 - DNA, 5918 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3839 - DNA, 5636 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3840 - DNA, 5750 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3841 - DNA, 5834 bp, Homo sapiens; identical to SEQ ID NO: 3828

SEQ ID NO: 3842 - DNA, 5873 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3843 - DNA, 3754 bp, Homo sapiens
gccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagcgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttcaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattaattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagtt

SEQ ID NO: 3844 - DNA, 3754 bp, Homo sapiens; identical to SEQ ID NO: 3843

SEQ ID NO: 3845 - DNA, 3242 bp, Homo sapiens
attgcccaatcactgaagagctgtgatcttcctaaacagttaaaagtcaggcacagctatgtaactcatacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaacttttgc

SEQ ID NO: 3846 - DNA, 3305 bp, Homo sapiens
atacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattacagggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaacttttgc

SEQ ID NO: 3847 - DNA, 3858 bp, Homo sapiens
ctactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaagaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgattttttctggagaattgtaaaataaagttttctatttttccttaaaaaaaaaaccggaattccgggcttgggaggctgaggcaggagactcgcttgaacccgggaggcagaggttgcagtgagccaagattgcgccattgcactccagagcctgggtgacagagcaagactacatctcaaaaaataaataaataaaataaaagtaacaataaaaataaaaagaacagcagagagaatgagcaaggagaaatgtcacaaactattgcaaaatactgttacactgggttggctctccaagaagatactggaatctcttcagccatttgcttttcagaagtagaaaccagcaaaccacctctaagcggagaacatacgattctttattaagtagctctggggaaggaaagaataaaagttgatagctccctgattgggaaaaaatgcacaattaataaagaatgaagatgaaagaaagcatgcttatgttgtaacacaaaaaaaattcacaaacgttggtggaaggaaaacagtatagaaaacattactttaactaaaagctggaaaaattttcagttgggatgcgactgacaaaaagaacgggatttccaggcataaagttggcgtgagctacagagggcaccatgtggctcagtggaagacccttcaagattcaaagttccatttgacagagcaaaggcacttcgcaaggagaagggtttaaattatgggtccaaaagccaagtggtaaagcgagcaatttgcagcataactgcttctcctagacagggctgagtgggcaaaatacgacagtacacacagtgactattagccactgccagaaacaggctgaacagccctgggagacaagggaaggcaggtggtgggagttgttcatggagagaaaggagagttttagaaccagcacatccactggagatgctgggccaccagacccctcccagtcaataaagtctggtgcctcatttgatctcagcctcatcatgaccctggagagaccctgataccatctgccagtccccgacagcttaggcactccttgccatcaacctgaccccccgagtggttctccaggctccctgccccacccattcaggccggaattc

SEQ ID NO: 3848 - DNA, 3047 bp, Homo sapiens
gggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaa

SEQ ID NO: 3849 - DNA, 3081 bp, Homo sapiens
aggcgcagcgtggccgcgggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactcttttttttt

SEQ ID NO: 3850 - DNA, 2950 bp, Homo sapiens
cggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactcttttttttt

SEQ ID NO: 3851 - DNA, 2956 bp, Homo sapiens
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaa

SEQ ID NO: 3852 - DNA, 2950 bp, Homo sapiens; identical to SEQ ID NO: 3850

SEQ ID NO: 3853 - DNA, 2950 bp, Homo sapiens; identical to SEQ ID NO: 3850

SEQ ID NO: 3854 - DNA, 1572 bp, Homo sapiens
atgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgctt

SEQ ID NO: 3855 - DNA, 1586 bp, Homo sapiens
atgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagtgcagtggctcacgcctgtaaacctagcactttgggaggctgaagcaggtggatcacttgagggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgctt

SEQ ID NO: 3856 - DNA, 982 bp, Homo sapiens
gagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaatagg

SEQ ID NO: 3857 - DNA, 1523 bp, Homo sapiens
atgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgctt

SEQ ID NO: 3858 - DNA, 1586 bp, Homo sapiens; identical to SEQ ID NO: 3855

SEQ ID NO: 3859 - DNA, 3834 bp, Homo sapiens
gccggatcccgggaagctaccggctgctggggtgctccggattttgcggggttcgtcgggcctgtggaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttc

SEQ ID NO: 3860 - DNA, 3834 bp, Homo sapiens; identical to SEQ ID NO: 3859

SEQ ID NO: 3861 - DNA, 3456 bp, Homo sapiens
gggttcgtcgggcctgtggaagaagccccgccacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgacgacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtcagacagctggcagtgg

SEQ ID NO: 3862 - DNA, 3804 bp, Homo sapiens
gccggatcccgggaagctaccggctgctggggtgctccggattttgcggggttcgtcgggcctgtggaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttc

SEQ ID NO: 3863 - DNA, 3804 bp, Homo sapiens; identical to SEQ ID NO: 3862

SEQ ID NO: 3864 - DNA, 3834 bp, Homo sapiens; identical to SEQ ID NO: 3859

SEQ ID NO: 3865 - DNA, 4420 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3866 - DNA, 5099 bp, Homo sapiens
gagaagggaccttcaggtccaggcaaagggggaacttctgtcgtgggaacgaaaaagaaagaggatttacagggtggggggacagaggggcagcaggaaccagaagggagacagtggcggtcgcggcggggccgatccgagagttccccttagagaacggagctcacgggcggggaggcctcacctgctagtaggacgcagaaagacagaaggcgaaagccaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattgg

SEQ ID NO: 3867 - DNA, 5144 bp, Homo sapiens
gagaagggaccttcaggtccaggcaaagggggaacttctgtcgtgggaacgaaaaagaaagaggatttacagggtggggggacagaggggcagcaggaaccagaagggagacagtggcggtcgcggcggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattgg

SEQ ID NO: 3868 - DNA, 4692 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaattggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaagtttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaa

SEQ ID NO: 3869 - DNA, 5144 bp, Homo sapiens; identical to SEQ ID NO: 3867

SEQ ID NO: 3870 - DNA, 3162 bp, Homo sapiens
ggcccctcgaggcgctctaacccaggctccgcccctcgacttgctctaataaccaggctgcgctcctcgagatgctctaacggccaggccccgccttcaaagcgctctaacaaccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttt

SEQ ID NO: 3871 - DNA, 3168 bp, Homo sapiens
ggcccctcgaggcgctctaacccaggctccgcccctcgacttgctctaataaccaggctgcgctcctcgagatgctctaacggccaggccccgccttcaaagcgctctaacaaccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttt

SEQ ID NO: 3872 - DNA, 3162 bp, Homo sapiens; identical to SEQ ID NO: 3870

SEQ ID NO: 3873 - DNA, 2198 bp, Homo sapiens
ctgaggtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaaacagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggatt

SEQ ID NO: 3874 - DNA, 3323 bp, Homo sapiens
ggcccctcgaggcgctctaacccaggctccgcccctcgacttgctctaataaccaggctgcgctcctcgagatgctctaacggccaggccccgccttcaaagcgctctaacaaccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttt

SEQ ID NO: 3875 - DNA, 3162 bp, Homo sapiens; identical to SEQ ID NO: 3870

SEQ ID NO: 3876 - DNA, 9161 bp, Homo sapiens
ctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcacaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgga

SEQ ID NO: 3877 - DNA, 10240 bp, Homo sapiens
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 3878 - DNA, 11097 bp, Homo sapiens
ctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacatgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcactagtcagctggctctttttcctatgaaatctatcagtacctttctccatccgttgttctcaataatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttat

SEQ ID NO: 3879 - DNA, 9416 bp, Homo sapiens
aagcgcgccgcctccccgccctctctcactccccgctcctctccgccgcgcactctcgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggcgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgga

SEQ ID NO: 3880 - DNA, 10475 bp, Homo sapiens
atggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 3881 - DNA, 10177 bp, Homo sapiens
gccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 3882 - DNA, 10471 bp, Homo sapiens
atggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 3883 - DNA, 10240 bp, Homo sapiens; identical to SEQ ID NO: 3877

SEQ ID NO: 3884 - DNA, 10259 bp, Homo sapiens
gctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgtaaaaaaaaaaaaaaaaa

SEQ ID NO: 3885 - DNA, 11044 bp, Homo sapiens
tgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagcaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacatgaacattattttgctttaaaaactataaacattgtaggagaattatagccagtcttcagttataaccactccaccctcctcactttctctctctctctctctttttttttttttttttttttgctattaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 3886 - DNA, 11044 bp, Homo sapiens; identical to SEQ ID NO: 3885

SEQ ID NO: 3887 - DNA, 3243 bp, Homo sapiens
ggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgcatggggagtcatgcgaaccgattctgttattgggaatgaaatctgtcaccgactgcttgacttgagcccaggggacacagagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatt

SEQ ID NO: 3888 - DNA, 2230 bp, Homo sapiens
ccagtgcgtgtctgttttggcaggaagaagacgtttcttccaaggagcagcctccccgctacatccagccagtgtcgcccttacacagctgcatgtcaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcagactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaataaaaaaaaaattagcctgcatggtggcacacgcctgtagttctagcttctcaggaggctaaggcaggaggatcatttgagcaccggagttggaggctgtactgagctatgattgtaccactgcaccccagcctgggcaacagagcaagaccctgtctc

SEQ ID NO: 3889 - DNA, 2228 bp, Homo sapiens
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaataaaaaaaaaattagcctgcatggtggcacacgcctgtagttctagcttctcaggaggctaaggcaggaggatcatttgagcaccggagttggaggctgtactgagctatgattgtaccactgcaccccagcctgggcaacagagcaagaccctgtctc

SEQ ID NO: 3890 - DNA, 2230 bp, Homo sapiens; identical to SEQ ID NO: 3888

SEQ ID NO: 3891 - DNA, 1294 bp, Homo sapiens
gtaagaaacggttgaactggatgcaatttttatcacagcttgtgtaagactgcctctgtccctcctctcacatgccattggttaaccagcagacagtgtgctcaggggcgttgcagctcattgctcttatagcctgtgagggcacggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 3892 - DNA, 972 bp, Homo sapiens
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 3893 - DNA, 778 bp, Homo sapiens
cccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagc

SEQ ID NO: 3894 - DNA, 972 bp, Homo sapiens
atggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 3895 - DNA, 778 bp, Homo sapiens; identical to SEQ ID NO: 3893

SEQ ID NO: 3896 - DNA, 2425 bp, Homo sapiens
ggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaaggtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctga

SEQ ID NO: 3897 - DNA, 5407 bp, Homo sapiens
cagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattac

SEQ ID NO: 3898 - DNA, 5407 bp, Homo sapiens; identical to SEQ ID NO: 3897

SEQ ID NO: 3899 - DNA, 5493 bp, Homo sapiens
gggccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgatctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatccaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagtacccatggagggcaagggctcccgtcccaagaacatgaccccataccggtcacctcctccctatgtcccaccttaacccgcaagcgcctgggtggaggcagggtagggcagggccctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggaccgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccaactgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtccagcttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattcccctgattgagggtgggtgggtggacccaggctccctttgcacacagagcagctacttctaagccatatcgactgttttgcagaggatttgtgtgtcctccctcaggaggggaggcctggtaggagggggggagagttctctgtcctactgctctcaagagggcatttccccttgcgccttctcccacagggcccagcccctctcccctgcccaagtccccagggggtactctggagtgagcagtccccctgtgggggagcctgtaaatgcgggctcagtggaccactggtgactgggctcatgcctccaagtcagagtttcccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 3900 - DNA, 5998 bp, Homo sapiens
agcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacag

SEQ ID NO: 3901 - DNA, 7448 bp, Homo sapiens
cgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagcc

SEQ ID NO: 3902 - DNA, 7448 bp, Homo sapiens; identical to SEQ ID NO: 3901

SEQ ID NO: 3903 - DNA, 1876 bp, Homo sapiens
gagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctataaaaaaaaaaaaaaaaaaaa

SEQ ID NO: 3904 - DNA, 1908 bp, Homo sapiens
cgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctat

SEQ ID NO: 3905 - DNA, 2059 bp, Homo sapiens
cgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctat

SEQ ID NO: 3906 - DNA, 2558 bp, Homo sapiens
agatttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctat

SEQ ID NO: 3907 - DNA, 1908 bp, Homo sapiens; identical to SEQ ID NO: 3904

SEQ ID NO: 3908 - DNA, 3292 bp, Homo sapiens
cgtacagctgtgtgctttctgctgcggaaagccaattataaaagtcccaataccagaatcaattttccattgtattcattgtgactaacaaaaagagtctgaggatgtgttttcacctctatctgtgagtggggcggaagttgctgggtgtcacacatggaagtggggtgagagcatgcgcgctggagcctgtgtggcctcttggtcaggtgcttgtggaggtttagctgatgccctttggctgtttctggactaagatcatcaactttcttaaactgaatctggttttccttgggctctgtcgtctgtgttgtgggtttgtggtggtggacacaggatgtgacattcttgctgggatccctgaagtgactatatcctctgcaataacagaaagtgaaacttatctttgtgctttaagagtgtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggcatgtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctct

SEQ ID NO: 3909 - DNA, 2732 bp, Homo sapiens
ggcgtggcgatgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctct

SEQ ID NO: 3910 - DNA, 3292 bp, Homo sapiens; identical to SEQ ID NO: 3908

SEQ ID NO: 3911 - DNA, 2732 bp, Homo sapiens; identical to SEQ ID NO: 3909

SEQ ID NO: 3912 - DNA, 2565 bp, Homo sapiens
agttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaactagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaaaaaaaaaaaaaaaaaaaaaaaaaa

SEQ ID NO: 3913 - DNA, 3292 bp, Homo sapiens; identical to SEQ ID NO: 3908

SEQ ID NO: 3914 - DNA, 2306 bp, Homo sapiens
cgggggtcgtggccgggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggcatgtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaagaa

SEQ ID NO: 3915 - DNA, 1542 bp, Homo sapiens
cgggggtcgtggccgggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggcatgtggggctgggacacggggtgggggccaagagctactgtgtccgggcagagacttgggtaataaaggctgttactcgacagacacccgggccatgcatgcccccgcttcctggctctggccaagtcagtaattatgacagtcacggttcagaagctaatcaaagataatgcatcacatgtaagtgacctttgttactgatgaggcaggccaaaatctggcctttgacctcacctcaaggctccaggccaaacaccaactttggaccaagcgtgttctggtcagagtcccagagccgccccttaccatggtgccttgtggaggggactctggtggctggaggtca

SEQ ID NO: 3916 - DNA, 2633 bp, Homo sapiens
tgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatcctgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcct

SEQ ID NO: 3917 - DNA, 3142 bp, Homo sapiens
tgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagta

SEQ ID NO: 3918 - DNA, 919 bp, Homo sapiens
atggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaagatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcg

SEQ ID NO: 3919 - DNA, 3332 bp, Homo sapiens
cccaggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaatggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcct

SEQ ID NO: 3920 - DNA, 3262 bp, Homo sapiens
agggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggaaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcaatcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttcgcatttagttggtactagagccagtcatccttaacaaatcttttcgcgttttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgtcccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatg

SEQ ID NO: 3921 - DNA, 3332 bp, Homo sapiens; identical to SEQ ID NO: 3919

SEQ ID NO: 3922 - DNA, 3332 bp, Homo sapiens; identical to SEQ ID NO: 3919

SEQ ID NO: 3923 - DNA, 3332 bp, Homo sapiens; identical to SEQ ID NO: 3919

SEQ ID NO: 3924 - DNA, 604 bp, Homo sapiens
agttccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacattgtatctatttcagtatttttctctatttttgtttcaatacaatttcctgaaggttgg

SEQ ID NO: 3925 - DNA, 794 bp, Homo sapiens
gtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttatttcttttttatttttttgtagagacaggggtggtctatgttgtccaggctggccttgagctggacgcaacagatcttcccgcctcaacctccgaaagtgctgggattaaaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacattgtatctatttcagtatttttctctatttttgtttcaatacaatttcctgaaggttgg

SEQ ID NO: 3926 - DNA, 485 bp, Homo sapiens
cttttttttctcgctccccggccatcttggcggctggtgttggttgggggttgtcccgcacctaaggcaggaagatggtggccgcaaagaagacgaaaaagtctctggagtcgatcaactctaggctccaacttgttatgaaaagtgggaagtacgtgctgggctacaagcagactctgaagatgatcagacaaggcaaagcgaagttggttatccttgccaacaactgtccagctttgaggaaatctgaaatagagtactatgccatgttggctaaaactggggtccatcactacagtggcaataatattgaactgggcacagcgtgtggaaaatactacagagtatgcacactggctatcattgacccaggtgattctgatattattagaagcatgccagaacagactggtgagaagtaaacaagaaagttttcctttaataaaactttgccagagctccttttgaaaaaaaaaaaaaaaaaa

SEQ ID NO: 3927 - DNA, 499 bp, Homo sapiens
ggggcttcctttctcgctccccggccatcttggcgtctgatcttggttggggcttgtcccgcacctaaggcaagaggatggtggctgcaaagaagacgaaaaagtctctggagtcaatcaactctcggctccaacttgttatgaaaagtggaaagtacgtgctggggtacaaacagactctgaagatgatcagacaaggcaaagcgaaattggttatcctcgccaacaactgtccagctttgaggaaatctgaaatagaatactatgccatgttggctaaaactggtgtccatcactacagtggcaataacattgaattgggcacagcgtgtggaaaatactacagagtatgcacactggctatcattgacccaggtgattccgatattattagaagcatgccagaacagactggtgagaagtaaacaagaaagttctcctttaataaaactttgccagagctcctttcaaaaaaaaaaaaaaaaaaaaaaaaaaaaaa

SEQ ID NO: 3928 - DNA, 794 bp, Homo sapiens; identical to SEQ ID NO: 3925

SEQ ID NO: 3929 - DNA, 2364 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaactttt

SEQ ID NO: 3930 - DNA, 2364 bp, Homo sapiens; identical to SEQ ID NO: 3929

SEQ ID NO: 3931 - DNA, 1704 bp, Homo sapiens
ctccatttccaaaatgtcgctttctaacaagctgacattggacaaaccagacgtcaaagggcagcgggtcattatgagagtggacttcaatgttcctgtgtagaataaccagataacaaacaaccagaggattaaggctactgtcttaagcatcaaattctgcttggacaatggagccaagtcagtagtccttatgagccacctaggccagcctgatggtgtccctatgcctgacaatactccttagagccatttgctgtagaattcaaatctctgctgggcaaggatgttctgttcttgaaagactgtgtaggcccagaagtggagaaagcctgtgccaacccagctgctgggtctgtcatcctgctggagaacctccactttcatgtggaagaagaagggaagggaaaactctgggaacaaggttaaagtgagcccgccaaaatagaagctttccgagcttcactttccaagctagggaatgtgcatgtcaatggtgcttttggcactgctcacagagcccacagctccatggtaggagtcagtctgccacagaaggctggtggttttttgatgaagaaggagctgaactactttgtgaaggtcttggagagcccatagcgacccttcctggccattctgggtggagctaaatttgcagacaagatccacctgatcaataatatgctggacaaagtcaatgagatgattattggtggtggaacggcttttaccttccttaaggtgctcaacaacatggagactggcacttctctgtttgatgaagagggagccaagattgtcaaagacctaatgtcccaagctgagaagaatggtgtgaagattaccttgcctattgactttgtcactgctgagaaatttgatgagaatgccaagactggccaagccactgtggcttctggcatacctgctggctgaatgggcttggactgtggtcctgaaagcagcaagaagtatgctgagactgtcacttgggctaagcagattgtgtggaatggtcctgtggggggtatttgaatgggaagcttttgcccagggaaccaaagccctcatggatgaggtggtgaaagccacttctaggggctgcattaccatcataggtggtggaaacactgccacttgctgtgccaaatggaacacagaggataaaatcagacatgtgagcactacgggtggtgccagtttagagctcctggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgttaaaaaaaaagtgagctgtgttagcttagttctcttttgatgtagcttatcctgattagctttgtcactgtttcactactcagcgtggaaacaagatgaaattccatttgtaggtagggagacgaaattgatgatccattaaatagacaataaaagtgtccattgaaaccatga

SEQ ID NO: 3932 - DNA, 1423 bp, Homo sapiens
gaattaccaagctgtctccccagctgtatttccaaaatgtcgctttctaacaagctgatgctggacaagctggacgtgaaagggaagccggtcgttatgagagtcgacttcaattttcctatgaagaacaaccaggtaacaaacaactggaggattaaggctgctgtcccaagcatcaaattctgcttggacaatggatccaagtcagtagtccttataagccacctaggttggcctgatggtgtccctatgcctgacaagtactcctcagagccagttgctgtagaactcaaatctctgctgggcaaggatgttctgttcttgaaggactgtgtaggcccagaagtggagaaagcctgtaccaacccagctgctgggtctgtcatcctgcgggagaacctccgctttcatgtggaggaagagggaagggaaaagatgcttctgggaacaaggctaatgctgatccagccaaattagaagctttccaagcttcacttcccaagctaggggaagtctatgtcaatgatgcttttggcactgctcacagagcccacagctccatggcagaagtcaatctgccacagaaggctggtggttttttgatgaagaaggagctgaactactttgccgaggccttggagagcccagagcgacccttcctggccatcctgggcagaactaaagttgcagacaagatccagctgatcaagaacatgctgggcaaagtcaatgagatgattattggtagtggaatggcttgtaccttccttaaggtgctcagcaacatggagattggcacttctctgtttgatgaagagggagccaagactgtcaaagacctaatgtccaaagctgagaagaatggtgtgaagattatcttgcctgttgactttgtcactgctggcaagtttgatgagaataccaagactggccaagccactgtggcttctggcatacctgctggctggctgggcttggactgtggccctgaaagcagcaagaagtatgctggggctgtcactcaggctaagcagattgtgtggaatggtcctgtggggggtttttgaatgggaagcttttgcccggggaaccaaagccctcatggatgaggtggtggagacactgccacttgctgtgtagaatggaacatggaggataaagtcagccaggtgagcactgggggtggtgccggtttagagctcctagaaggtaaagtccatcctggggttgatactcttggcaatatttagtactttcctgccttttagttcctgtgcacagcccctaagtcaacttagcattttctgcatctccacttggcattagctaaaactttccatgtcaagattcagctagtggccaagagatgcagtgccgggaacccttaaatggttacacagaatctcagctcatctctactgca

SEQ ID NO: 3933 - DNA, 3631 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaata

SEQ ID NO: 3934 - DNA, 2296 bp, Homo sapiens
gtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagctggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtattttttttttttttggctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtaaaaaaaaaaaaaaaaaaaaa

SEQ ID NO: 3935 - DNA, 7191 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaacccccggctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttt

SEQ ID NO: 3936 - DNA, 7138 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttt

SEQ ID NO: 3937 - DNA, 3116 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggcaagggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctac

SEQ ID NO: 3938 - DNA, 1851 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggtacgtgagacccctcacctctgcgtgcattcctttggtgttttcatgggattgtggctttttgtccattctattacttttagtattactctctagtggttgtggagaattttaaatcacagtctttatgtttcctgaggtttccatcatagcaatgcattctggtaattaggaaaaaaaacaacaaaaaccaacaatgaaaaaattgagaataaggcagggtgcggtggctaacacctgcagtcccagcactttcggaggctgaagtgagaggattgcttaaacccaggagtttgataccaggctgagcaacatagggagacctccatctctactc

SEQ ID NO: 3939 - DNA, 7189 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggcaagggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttta

SEQ ID NO: 3940 - DNA, 3119 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctac

SEQ ID NO: 3941 - DNA, 753 bp, Homo sapiens
ggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 3942 - DNA, 1041 bp, Homo sapiens
cacgagcccgcccccagcgggagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcc

SEQ ID NO: 3943 - DNA, 1011 bp, Homo sapiens
ggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcctttgg

SEQ ID NO: 3944 - DNA, 1041 bp, Homo sapiens; identical to SEQ ID NO: 3942

SEQ ID NO: 3945 - DNA, 1259 bp, Homo sapiens
acatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaac

SEQ ID NO: 3946 - DNA, 1259 bp, Homo sapiens; identical to SEQ ID NO: 3945

SEQ ID NO: 3947 - DNA, 1259 bp, Homo sapiens; identical to SEQ ID NO: 3945

SEQ ID NO: 3948 - DNA, 1259 bp, Homo sapiens; identical to SEQ ID NO: 3945

SEQ ID NO: 3949 - DNA, 1156 bp, Homo sapiens
ggacgttgacattgcgaggggcacagtattgggcagaaaccaaacactgacccgattcctcccccaggaggtggacgtgggtttggctgccgatgtaggaacactggagcgcctgcccaaggtcatcgggaaccagaggtggcgtgcagggggtgtgggggtgtaaacagagaccccagagcatctcccagccccggggtggcagcctcctgatgcacgcttgcctttgcagcctggtcaacgagctggccttcaccgcccacaagatgatggctgacgaggccctggacagtgggctggtcaggtagggccatgggctggtagctcagtgctgggggcagccaggcctggagggaaggaggcctctccgggtccccttgtctcctcgctctagaattcctagtggcatcctttcttggtgagctcatttctttattgtggggtcagccccctgctctgattgggctgtttctctggggtcttgggccttcctctgtgagtggccacttcttcatctgcgggaggctggaggagagagcccttcccagcccacccggtccctgatctctttcactgcagccgggtgttcccagacaaagaggtcatgctggatgctgccttacccctggcgcccgagatttccagcaagaccaccgtgttggtgcagagcaccaaggtcaacctgctgtattcccgcgaccattcggtggccgagagcctcaactacgtggtaaggtgcacgctccgaccaatcacagccctcctctaaccccaggcgaccaaccagggtgcagggtgctctcatgctttatcctgattggcccctgctaatctctctcctcgttctctctcttcaccctcggtaccaggcgtcctggaacatgagcatgctgcagacccaagacctcgtgaagtcggtccagcccacgactgagaacaaggaactgaaaaccgtcaccttctccaagctctgagagccctcgcgtcccagccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaa

SEQ ID NO: 3950 - DNA, 210 bp, Homo sapiens
ggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggaagctacatagtgtctcactttccaagatcattctacaagatgtcagtgcac

SEQ ID NO: 3951 - DNA, 1216 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagg

SEQ ID NO: 3952 - DNA, 1988 bp, Homo sapiens
gtgctgcagccgctgccgccgattccggatctcattgccacgcgcccccgacgaccgcccgacgtgcattcccggtacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaattcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 3953 - DNA, 1988 bp, Homo sapiens; identical to SEQ ID NO: 3952

SEQ ID NO: 3954 - DNA, 1661 bp, Homo sapiens
tgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 3955 - DNA, 1619 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaatctagggcactctgggaacctataaaggcaggtatttcgggccctcctcttcaggaatcttcctgaagacatggcc

SEQ ID NO: 3956 - DNA, 1619 bp, Homo sapiens; identical to SEQ ID NO: 3955

SEQ ID NO: 3957 - DNA, 2474 bp, Homo sapiens
ctcagcgcccagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacgggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 3958 - DNA, 1619 bp, Homo sapiens; identical to SEQ ID NO: 3955

SEQ ID NO: 3959 - DNA, 2517 bp, Homo sapiens
gccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaatatttta

SEQ ID NO: 3960 - DNA, 3317 bp, Homo sapiens
agcgatagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaataggaaaataaccaagcacaaagttatattccatcctttttactgatttttttttcttctatctgttccatctgctgtattcatttctccaatctcatgtccat

SEQ ID NO: 3961 - DNA, 2679 bp, Homo sapiens
atggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctag

SEQ ID NO: 3962 - DNA, 3022 bp, Homo sapiens
ggggcgagccagccgcgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaggccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagagcgtacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgccc

SEQ ID NO: 3963 - DNA, 3302 bp, Homo sapiens
agcgatagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaataggaaaataaccaagcacaaagttatattccatcctttttactgatttttttttcttctatctgttccatctgctgtattcatttctccaatctcatgtccat

SEQ ID NO: 3964 - DNA, 3317 bp, Homo sapiens; identical to SEQ ID NO: 3960

SEQ ID NO: 3965 - DNA, 1684 bp, Homo sapiens
ggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaaggggcgctgcctccgggtctggggtcctggcctgcgtggcctgttggcacgtgtttctcttccccgcccggcctccagttgtgtgctctcacacaggcttccttctcgaccggcaggggctggctggcttgcaggccacgaggtgggctctaccccacactgctttgctgtgtatacgcttgttgccctgaaataaatatgcacattttatccatgaa

SEQ ID NO: 3966 - DNA, 4028 bp, Homo sapiens
aagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttcttttttttttttttaatttttccccccaaccatcgtgatttgtcttttcatgcagattagttagaattcactgccaggtttcttctgcccaccaaaatgatccagtctggaataacattttgtaaaaaaaaaatatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaaca

SEQ ID NO: 3967 - DNA, 2010 bp, Homo sapiens
atgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcacgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccaggagctaccaatatgataggttacatggggcagactgcctaccaataccctcctcctcctccccctcctcctccttcacgtaaatgaaaccactcaagtggtagtgactccagcagacttaattacattttaaggaacactgtc

SEQ ID NO: 3968 - DNA, 4028 bp, Homo sapiens; identical to SEQ ID NO: 3966

SEQ ID NO: 3969 - DNA, 2366 bp, Homo sapiens
gtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3970 - DNA, 1604 bp, Homo sapiens
attttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagtatgaaagatattttactctgatttgataatgctgataaaccttttctaataaccctccaaaattagtactgtagaaaccagtatattttgaggcctgagaacattaaaagcattgctaggtttctgataatccatcatcatatcatttgtcagagcattatggttaaatgcaaggattctgaattcttgagtttgaaatttagctctgctgattacaagctgtataattttgcacaattttgtgtcttggtgctgcagtttcttcatctgtgaaatgggagtaataccacttacatgagacttgctgtgaggatggt

SEQ ID NO: 3971 - DNA, 3557 bp, Homo sapiens
caggacgtgaaacgggggcggtttgggaagtttagagaccattctccgccgaccaaaacccgtcaaaggattatcagacacgcgggtcggacggtccacatcagccggcagcccgggcgggtcccggggtgcgagcagcgcacttccgtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccatt

SEQ ID NO: 3972 - DNA, 4761 bp, Homo sapiens
gccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggagtgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataa

SEQ ID NO: 3973 - DNA, 4028 bp, Homo sapiens; identical to SEQ ID NO: 3966

SEQ ID NO: 3974 - DNA, 3557 bp, Homo sapiens; identical to SEQ ID NO: 3971

SEQ ID NO: 3975 - DNA, 2724 bp, Homo sapiens
attttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctaggttctccggcgcttggcaaccaaatggggctacagagaagcatctaagccagttcacagagcgagcgtgtgtggggacttctcactgccacggacccttgatgcatgctccccgcgctccagtggtcccgtgtcagaaggcggagttttcgaaaggaggccgccaaaaataaaaggcaaagagacgggatcggctgcagcggtttcccaaaggaggagggagtgtgcatcggtctgatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttcttttttttttttttaatttttccccccaaccatcgtgatttgtcttttcatgcagattagttagaattcactgccaggtttcttctgcccaccaaaatgatccagtctggaataacattttgt

SEQ ID NO: 3976 - DNA, 2871 bp, Homo sapiens
cggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacgctccaggccatgcccgcagccggaggcgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagc

SEQ ID NO: 3977 - DNA, 2919 bp, Homo sapiens
cggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggcgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagc

SEQ ID NO: 3978 - DNA, 2919 bp, Homo sapiens; identical to SEQ ID NO: 3977

SEQ ID NO: 3979 - DNA, 2647 bp, Homo sapiens
cggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcag

SEQ ID NO: 3980 - DNA, 2387 bp, Homo sapiens
actgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacgtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 3981 - DNA, 1867 bp, Homo sapiens
tgtggacgctgtgaatcgtggctggcccggttctccgcttctccccatcccctactttcctccctccctccctttccctccctcgtcgactgtttcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagagtgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgatttttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaaaaaaaaaaaaaaaaaa

SEQ ID NO: 3982 - DNA, 1537 bp, Homo sapiens
gccgataccggtgtgaacggtgtgaatcgtggctggaccggttctccgcttctccccatcccctactttcctccctccctccctttccctccctcgtcgactgtcgcttgctggtggcagactccctgacccctccctcacccctacctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcggcccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcacacttctggtataaaaaaagctctatggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggtggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacgagcaagcagagaaaagcatcagccttccagagttactgtctgtttaagacagaaacagcagtaaataatgaggaaaatgaattagctccagcgctggaacaactaactaacttggtgttacctgtaagtgaaaa

SEQ ID NO: 3983 - DNA, 2791 bp, Homo sapiens
accgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagcctttt

SEQ ID NO: 3984 - DNA, 2791 bp, Homo sapiens; identical to SEQ ID NO: 3983

SEQ ID NO: 3985 - DNA, 1791 bp, Homo sapiens
agataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttggaaagggcctggggaaaccatggcaaagtggatccagttaga

SEQ ID NO: 3986 - DNA, 2791 bp, Homo sapiens; identical to SEQ ID NO: 3983

SEQ ID NO: 3987 - DNA, 2942 bp, Homo sapiens
  misc_feature (1)...(2942): n = A,T,C or G
cgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttggaacttcctgcaggtaaacagttcttgtgtgggtttgggcccntctccttttggaaaaggtaagggtgaaggtgaatcttgcttattntgggggtttcaggtttnagtttttaaaatatcttttggacctgtgggtgnaaaagcagaaatacagntggattgggttatgagtatttacgt

SEQ ID NO: 3988 - DNA, 3538 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccaaagtttttatgtagcagggaaaatatatatctaaatttaaaaatcatttgggttaatatggctcttcataattctaaaactaatgctctctaaaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagaacggtggctcacgcctgtaatcccagcactttgggaggctgactgagattgtgccactgcactccagcctgggcgacagagtgagactccgtctc

SEQ ID NO: 3989 - DNA, 3487 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtgaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccaaagtttttatgtagcagggaaaatatatatctaaatttaaaaatcatttgggttaatatggctcttcataattctaaaactaatgctctctaaaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagaacggtggctcacgcctgtaatcccagcactttgggaggctgactgagattgtgccactgcactccagcctgggcgacagagtgagactccgtctc

SEQ ID NO: 3990 - DNA, 3102 bp, Homo sapiens
ggtgacgtggacacggaagtggtcgtcgtcgcggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggactgtctttgttcctttgtgttttgagggctggctgggtaggagtgggggtggtttgtctgtggcagtgaatttttgccaggagaggaacattaaatgccaaaggtaggtggcagtatttcagtctctgccccagccgacaggcagagagaccttcacaaataataagacccaagaaagactgggcctcacctaggcttgtgttccaggag

SEQ ID NO: 3991 - DNA, 1295 bp, Homo sapiens
ggtgacgtggacacggaagtggtcgtcgtcgcggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctcttttttgtaggacttcttcattccttagtcagggttccctgaaggaatgaggagaaatgggaggtggcggggggg

SEQ ID NO: 3992 - DNA, 1295 bp, Homo sapiens; identical to SEQ ID NO: 3991

SEQ ID NO: 3993 - DNA, 3446 bp, Homo sapiens
gttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggatt

SEQ ID NO: 3994 - DNA, 387 bp, Homo sapiens
atgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctag

SEQ ID NO: 3995 - DNA, 5069 bp, Homo sapiens
cgggctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtgagtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttctatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaa

SEQ ID NO: 3996 - DNA, 4126 bp, Homo sapiens
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattac

SEQ ID NO: 3997 - DNA, 3889 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattac

SEQ ID NO: 3998 - DNA, 4126 bp, Homo sapiens; identical to SEQ ID NO: 3996

SEQ ID NO: 3999 - DNA, 4126 bp, Homo sapiens; identical to SEQ ID NO: 3996

SEQ ID NO: 4000 - DNA, 2352 bp, Homo sapiens
cagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaaccc

SEQ ID NO: 4001 - DNA, 1673 bp, Homo sapiens
gctatctttctggcacatggacccagttttaaagagaagactgaagttgaaccatttgaaaatattgaagtctataacctaatgtgtggtaaaggagttgttgctttccagtgtaaagctactttgaacttattttttcaaaaaacagatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaacttttgc

SEQ ID NO: 4002 - DNA, 7183 bp, Homo sapiens
tgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 4003 - DNA, 7105 bp, Homo sapiens
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 4004 - DNA, 7110 bp, Homo sapiens
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 4005 - DNA, 7192 bp, Homo sapiens
tgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaaggttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 4006 - DNA, 7183 bp, Homo sapiens
gggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccaattctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 4007 - DNA, 7381 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaaggttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 4008 - DNA, 7110 bp, Homo sapiens; identical to SEQ ID NO: 4004

SEQ ID NO: 4009 - DNA, 7110 bp, Homo sapiens; identical to SEQ ID NO: 4004

SEQ ID NO: 4010 - DNA, 7110 bp, Homo sapiens; identical to SEQ ID NO: 4004

SEQ ID NO: 4011 - DNA, 4126 bp, Homo sapiens
cagtcccggagcagaagcagcagcagcagcagcagccctcgtctgttttccaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaggggatctaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaaggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaa

SEQ ID NO: 4012 - DNA, 4091 bp, Homo sapiens
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaggggatctaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataa

SEQ ID NO: 4013 - DNA, 944 bp, Homo sapiens
gcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagaaaaaaaaaaaaaaa

SEQ ID NO: 4014 - DNA, 4091 bp, Homo sapiens; identical to SEQ ID NO: 4012

SEQ ID NO: 4015 - DNA, 4091 bp, Homo sapiens; identical to SEQ ID NO: 4012

SEQ ID NO: 4016 - DNA, 4091 bp, Homo sapiens; identical to SEQ ID NO: 4012

SEQ ID NO: 4017 - DNA, 4386 bp, Homo sapiens
cgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagagcgggagttaacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgc

SEQ ID NO: 4018 - DNA, 4174 bp, Homo sapiens
gacgcggggaggcgcgctcgctccgcgctccattagctcgctcgttccctcctccctcggcacccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 4019 - DNA, 4253 bp, Homo sapiens
tcagacatggcggcggatctaaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaaaaaaaaaaaaaaaaaa

SEQ ID NO: 4020 - DNA, 4342 bp, Homo sapiens
gacgcggggaggcgcgctcgctccgcgctccattagctcgctcgttccctcctccctcggcacccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 4021 - DNA, 4516 bp, Homo sapiens
gacgcggggaggcgcgctcgctccgcgctccattagctcgctcgttccctcctccctcggcacccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 4022 - DNA, 3716 bp, Homo sapiens
gacgcggggaggcgcgctcgctccgcgctccattagctcgctcgttccctcctccctcggcacccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagt

SEQ ID NO: 4023 - DNA, 4516 bp, Homo sapiens; identical to SEQ ID NO: 4021

SEQ ID NO: 4024 - DNA, 1630 bp, Homo sapiens
gagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcaaaaaaaaaaaaaaaaaaaaaaaaaaaaa

SEQ ID NO: 4025 - DNA, 3095 bp, Homo sapiens
tgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataagggagtctttaatctgtgttttccttgtctgggttaatgactgtttatttaaagagtgctgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccttctgatccttaaccaa

SEQ ID NO: 4026 - DNA, 3095 bp, Homo sapiens; identical to SEQ ID NO: 4025

SEQ ID NO: 4027 - DNA, 2314 bp, Homo sapiens
ggaggggagaccttggcggacggcggagccccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaacagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcctagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatttttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaaggactacttattgtagtcatcctggaatatctccgtcaactcatattttcatgctgttcatgaaagattcaatgcccctgaatttaaatagctcttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccaaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattc

SEQ ID NO: 4028 - DNA, 4676 bp, Homo sapiens
cccttccctaccctgctcggctgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttcttttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaataattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaacagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattatggagctgattttctagtctgtggatcagctatgcctttggacacttctcttttccattgtgccttttgaatgttgtcttctcactcagcatcagcacttcgatctaaatgcagactaggtagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 4029 - DNA, 2053 bp, Homo sapiens
agcggagtgggctccccacccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaagctaatagtatccagtcacagtgaatttgaaagctggaatagtttgtctttacaatgggtttctgttcactgtcagttatcattatattttggcctttggtggggatgcctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagcaaaaaaaaaaaaaaaa

SEQ ID NO: 4030 - DNA, 5191 bp, Homo sapiens
ggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcac

SEQ ID NO: 4031 - DNA, 3901 bp, Homo sapiens
aagatggcggcgtgtggacgtgtacggaggatgttccgcttgtcggcggcgctgcatctgctgctgctattcgcggccggggccgagaaactccccggccatggcgtccacagccagggccagggtcccggggccaactttgtgtccttcgtagggcaggccggaggcggcggcccggcgggtcagcagctgccccagctgcttcagtcatcgcagcttcagcagcaacagcagcagcagcaacagcaacagcagcttcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaa

SEQ ID NO: 4032 - DNA, 5191 bp, Homo sapiens; identical to SEQ ID NO: 4030

SEQ ID NO: 4033 - DNA, 5191 bp, Homo sapiens; identical to SEQ ID NO: 4030

SEQ ID NO: 4034 - DNA, 5191 bp, Homo sapiens; identical to SEQ ID NO: 4030

SEQ ID NO: 4035 - DNA, 4122 bp, Homo sapiens
cgggttcgggtggagctgagccggagacaggcaattgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcactcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgaagctgggcttcgcatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccggaacccagcggctgctccagccaccggcaacaagaagacccactgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgtcctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccccaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccaccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggtt

SEQ ID NO: 4036 - DNA, 1773 bp, Homo sapiens
gagctgagccggagacaggtaaccgtgcgctgtcgccgcgcccgtcccagtgccgggtgtcgcggcgcttggcggcccggggttggagatcgcggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtaaggcccagagagaggcgtgcaaggcagatcgtcaaggccccatgttccagcatggagttccgctcaccaacataacccagagccctgggtgcatctagactttaaaaaaatatttaaagtcggccgggcgcagtgtctcacgcctgtaatcccagcactttgggaggccgaggtgggcagatcacctgagttcgggagttggagaccagcctgaccaacatggagaaactccatctctactaaaaatacaaaattagctgggcgtggtggcgcgcgcctgtaatcccagctactcaggaggctgaggcaggagaatcgcttgaacccgggaggtggaggttgcagtgagccgagattacgccattgcactccagcctgggccaacaagagcgaaactctgtctcaaagaaaaaaataaataaataaaaaatatatgtatatgt

SEQ ID NO: 4037 - DNA, 3373 bp, Homo sapiens
gagctgagccggagacaggtaaccgtgcgctgtcgccgcgcccgtcccagtgccgggtgtcgcggcgcttggcggcccggggttggagatcgcggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatctgcccctcatttatcactctgaccttcacagggacagatctgatttatttattttggttaaaaaaaaaaaaaaggaacagaaacaactttgcattgcattggcttgacccataaactaagttatatccgtgggca

SEQ ID NO: 4038 - DNA, 3373 bp, Homo sapiens; identical to SEQ ID NO: 4037

SEQ ID NO: 4039 - DNA, 1819 bp, Homo sapiens; identical to SEQ ID NO: 2857

SEQ ID NO: 4040 - DNA, 4665 bp, Homo sapiens
agccagcccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggtcatggtttgacaaacagagtgagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 4041 - DNA, 4839 bp, Homo sapiens
agccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccagtggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaagtttggtaattttcacaaagaaaaaacatctgcagtctctttccctggtggcctggcatggaagtggtgtaggacatgctgattaagacaaacacaattggctgggcatggtggctcacacctgtaatcccagcactttgggaggctgacgcaggtggattgcttgagtgcaggagttggagaccagcccgggcagcacagggagacccctgtctctacaaaaa

SEQ ID NO: 4042 - DNA, 2175 bp, Homo sapiens
ctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcattgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaatctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaat

SEQ ID NO: 4043 - DNA, 2175 bp, Homo sapiens; identical to SEQ ID NO: 4042

SEQ ID NO: 4044 - DNA, 2065 bp, Homo sapiens
caagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggcagaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagtgcaggtttgatccagccagtatagaactagctctg

SEQ ID NO: 4045 - DNA, 3210 bp, Homo sapiens
caagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattaga

SEQ ID NO: 4046 - DNA, 2543 bp, Homo sapiens
caagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggcagaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcc

SEQ ID NO: 4047 - DNA, 2300 bp, Homo sapiens
acggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgct

SEQ ID NO: 4048 - DNA, 2551 bp, Homo sapiens
gggcgtggccgacccggcgctagcccgcccgcccgcccgccggctctcgcgcctccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgct

SEQ ID NO: 4049 - DNA, 5315 bp, Homo sapiens
actcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggcaagccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcacgtgtctggagttctttgccaagagggagaggctgaaatccccagccgcctcacctgcagctcagctccatcctacttgaaacctcacctgttcccaccgcattttctcctggcgttcgcctgctagtgtgctgacttctttagccaaggagcatggacctgcctcacctgcacgtggcatgcacctgcgcctcacctccatttcacctgc

SEQ ID NO: 4050 - DNA, 5311 bp, Homo sapiens
actcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcacgtgtctggagttctttgccaagagggagaggctgaaatccccagccgcctcacctgcagctcagctccatcctacttgaaacctcacctgttcccaccgcattttctcctggcgttcgcctgctagtgtgctgacttctttagccaaggagcatggacctgcctcacctgcacgtggcatgcacctgcgcctcacctccatttcacctgc

SEQ ID NO: 4051 - DNA, 5067 bp, Homo sapiens
ctcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcc

SEQ ID NO: 4052 - DNA, 1817 bp, Homo sapiens
atccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgca

SEQ ID NO: 4053 - DNA, 1888 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 4054 - DNA, 1870 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaag

SEQ ID NO: 4055 - DNA, 1870 bp, Homo sapiens; identical to SEQ ID NO: 4054

SEQ ID NO: 4056 - DNA, 1987 bp, Homo sapiens
atttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttacatgctgtttgttccatatgctttgtgtgttgctttcgtagagctgcttaacctgcatgacagagttattatacatacatgaatttcaattggcctgttggggagtttggcagagtgagaacattagaaggctaatgttaaaaatgggatgcttggccgggtgc

SEQ ID NO: 4057 - DNA, 1314 bp, Homo sapiens
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 4058 - DNA, 1987 bp, Homo sapiens; identical to SEQ ID NO: 4056

SEQ ID NO: 4059 - DNA, 1987 bp, Homo sapiens; identical to SEQ ID NO: 4056

SEQ ID NO: 4060 - DNA, 1928 bp, Homo sapiens
tgcactccagcctgggtgacagaacaagacaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgctcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 4061 - DNA, 1538 bp, Homo sapiens
atgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 4062 - DNA, 1928 bp, Homo sapiens; identical to SEQ ID NO: 4060

SEQ ID NO: 4063 - DNA, 1928 bp, Homo sapiens; identical to SEQ ID NO: 4060

SEQ ID NO: 4064 - DNA, 1229 bp, Homo sapiens
atggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 4065 - DNA, 1229 bp, Homo sapiens; identical to SEQ ID NO: 4064

SEQ ID NO: 4066 - DNA, 4445 bp, Homo sapiens
gttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtgagtgcctggcctggccactccccagaaccccttgaccagtggccagctgtcagcacccttgtacccaccattatcagagcccctggtcccggctttcacctgtcgcatccctgctccagagactagcccccttcccccgtctctgcaaccacaggtctctgccctaagtaagcccccagcctgcaattctctgcccggctcctgttccctcccctcccttgcatctcagaagctcagagaagggctcctcgctttgggattgaggaggggagaagctggaaactccatcctcccaccagaacctgcatgaaacctgagctcctggacccctctcctctcagccggcacccagacgcatcttccagggtctggggcctgacactggctcgagggctggccctttctccttgtggacccgctgggcgggggatggggcaaccctcgcgcgttgcttatcccagccggatgccctgggagggcggcggccctggcctcgccagcctcaagtctaacctggggtgcgggtgcgtgggccgcgtgcatgtctgcgtggagcaagcgcgccgagagcggtcggggctggcgccggggcgctctaacccactaacccggcgagcaggagcaagcccggcctcacgagggcgcccgcccgctgcgggctgtcttcaccgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttggggtgtgtgcctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtggggcagggctggtcacgcctcctgtgctcgggcagaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccacaccgtaggcgttccccccaagtaaagttaggtagcaaaagcctccggtatgaagcctcttttatttgtgcctcagaatcagtctggtgcccctggcatcagggaagggggtgggaggaacagtttctctttgttcttttcttccatccctctttgtgtcccttctgagcctcactggctgagccgggaaggccagtcccagacaggcccgggacaagggtgtgcggtgggcccctgcccctggcggggtctgtgctt

SEQ ID NO: 4067 - DNA, 2818 bp, Homo sapiens
gttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagcaagcccggcctcacgagggcgcccgcccgctgcgggctgtcttcaccgcagacgggaagctgctcagcaccggcttcagcaggatgagtgagcggcaactcgcgctctgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccacaccgtaggcgttccccccaagtaaagttaggtagcaaaagcctccggtatgaagcctcttttatttgtgcctcagaatcagtctggtgcccctggcatcagggaagggggtgggaggaacagtttctctttgttcttttcttccatccctctttgtgtcccttctgagcctcactggctgagccgggaaggccagtcccagacaggcccgggacaagggtgtgcggtgggcccctgcccctggcggggtctgtgctt

SEQ ID NO: 4068 - DNA, 4288 bp, Homo sapiens
gttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtctctgccctaagtaagcccccagcctgcaattctctgcccggctcctgttccctcccctcccttgcatctcagaagctcagagaagggctcctcgctttgggattgaggaggggagaagctggaaactccatcctcccaccagaacctgcatgaaacctgagctcctggacccctctcctctcagccggcacccagacgcatcttccagggtctggggcctgacactggctcgagggctggccctttctccttgtggacccgctgggcgggggatggggcaaccctcgcgcgttgcttatcccagccggatgccctgggagggcggcggccctggcctcgccagcctcaagtctaacctggggtgcgggtgcgtgggccgcgtgcatgtctgcgtggagcaagcgcgccgagagcggtcggggctggcgccggggcgctctaacccactaacccggcgagcaggagcaagcccggcctcacgagggcgcccgcccgctgcgggctgtcttcaccgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttggggtgtgtgcctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtggggcagggctggtcacgcctcctgtgctcgggcagaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccacaccgtaggcgttccccccaagtaaagttaggtagcaaaagcctccggtatgaagcctcttttatttgtgcctcagaatcagtctggtgcccctggcatcagggaagggggtgggaggaacagtttctctttgttcttttcttccatccctctttgtgtcccttctgagcctcactggctgagccgggaaggccagtcccagacaggcccgggacaagggtgtgcggtgggcccctgcccctggcggggtctgtgctt

SEQ ID NO: 4069 - DNA, 2325 bp, Homo sapiens
cagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccacaccgtaggcgttccccccaagtaaagttaggtagcaaaagcctccggtatgaagcctcttttatttgtgcctcagaatcagtctggtgcccctggcatcagggaagggggtgggaggaacagtttctctttgttcttttcttccatccctctttgtgtcccttctgagcctcactggctgagccgggaaggccagtcccagacaggcccgggacaagggtgtgcggtgggcccctgcccctggcggggtctgtgcttctctgggtgggtgaggtggggcaggggagagccgggggttagcaccattggatgaagggttttagagtcagtctccgtgtgggggcaagtgggatgtacaaccacagaggctagcagcagctggtgggaaggggtgggggtggcgccagggccctgggcgagccctttgtgtccagtctacttgggtctagtgcttaccccagcccaatatgctccccactctccgaggcaccatgagggagtcagggcttgcacaggccagggggctacgttggacacactccctgatcacaaaaaaaaaaaaaaaaaaatgtgccttgggggatgggactccaacttctggctgcccaaggagaagctggaaccaccctgagacccaggacgggtgtgggggctgggggagccgggtaccccgctaagtgcacttga

SEQ ID NO: 4070 - DNA, 4288 bp, Homo sapiens; identical to SEQ ID NO: 4068

SEQ ID NO: 4071 - DNA, 2728 bp, Homo sapiens
cagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtctctgccctaagtaagcccccagcctgcaattctctgcccggctcctcaggagcaagcccggcctcacgagggcgcccgcccgctgcgggctgtcttcaccgcagacgggaagctgctcagcaccggcttcagcaggatgagtgagcggcaactcgcgctctgggacccggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccacaccgtaggcgttccccccaagtaaagttaggtagcaaaagcctccggtatgaagcctcttttatttgtgcctcagaatcagtctggtgcccctggcatcagggaagggggtgggaggaacagtttctctttgttcttttcttccatccctctttgtgtcccttctgagcctcactggctgagccgggaaggccagtcccagacaggcccgggacaagggtgtgcggtgggcccctgcccctggcggggtctgtgctt

SEQ ID NO: 4072 - DNA, 4288 bp, Homo sapiens; identical to SEQ ID NO: 4068

SEQ ID NO: 4073 - DNA, 2225 bp, Homo sapiens
cgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtcggtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaa

SEQ ID NO: 4074 - DNA, 3786 bp, Homo sapiens
gtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaacacgtgccgccctaaggccaaggcggagctggctgctgtcgcttctgcccacattccatgggtgctgtcgagctgtaggtccaagccccacatcaggggagtgagtggggtacaatcctcccatgctgggccccactctggagataggcctggggaatgcccaagaaggaagcccagcccttctgggattttcacatccacagagaatgggtgctggcagccaacggcaacgaggagaaaagctgaccgccttctcagatcaggatgaggtgtttttacaccaaccccgaggatctgcagccttctcaggttaaattaaacctgtcacagacacaggaagggaaaagagcacataacaacaattatattgacatctaagccaggtcacatgctctgatttggctgaaattacaggataaaggaaaaatcctataggcaccatggctggaaacaaatggcctcaaaggaacgctggtggccgtggctttgtgcaacgacagccagtgttgtgtgacccagcgacgtgcaggccagggagggtacccttctactgatcaagagggaaagcgggaaggacgcacagctgtggtttccaacctgcacggaggcacccccatgaactcacagagcaccatcagatccttctgaattttgaaggaagcaatgatactctgctctgctcaaggccattcatggtctcaacattaacgttaccttgctttatagggtatcttccctctctctgccaggctgggttgtggcagtcactgaacaagcaattactgtgaaggtcgacgtggaaaaatgaggcaatgagggtggcggtgttctaccagattccaagttgaagaggtgctcgacaggcacacacatcccatgactaaacaaataacatgaacatttctctttatgtattacttttctagacatccactataagttgccaggacacaaatgcttattattggggtttacttatttaataaatggaactgtggggg

SEQ ID NO: 4075 - DNA, 3786 bp, Homo sapiens; identical to SEQ ID NO: 4074

SEQ ID NO: 4076 - DNA, 3786 bp, Homo sapiens; identical to SEQ ID NO: 4074

SEQ ID NO: 4077 - DNA, 3786 bp, Homo sapiens; identical to SEQ ID NO: 4074

SEQ ID NO: 4078 - DNA, 3786 bp, Homo sapiens; identical to SEQ ID NO: 4074

SEQ ID NO: 4079 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 4080 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4081 - DNA, 1101 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 4082 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 4083 - DNA, 1500 bp, Homo sapiens
acggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgctgcccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgccgctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctggtccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggctctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaattttatgtgcactgagctgcaacttcttacttccctactgaaataagaatctgaatataaatttgttttctcaaatatttgctatgagaggttgatggattaattaaataagtcaattcctggaatttgagagagcaaataaagacctgagaacct

SEQ ID NO: 4084 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4085 - DNA, 1098 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtga

SEQ ID NO: 4086 - DNA, 1703 bp, Homo sapiens; identical to SEQ ID NO: 3424

SEQ ID NO: 4087 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4088 - DNA, 3714 bp, Homo sapiens
  misc_feature (1)...(3714): n = A,T,C or G
aatctgcgtcgggtccttcttcctgaatgactcatgacgcgtccccaattcccactcccattgggtgtcggaccnntctagaaggccggtcagcgtctccgcagtcccggttctgaagtccccagtcacccacccggactcagattctccccagacgccgagatgcgggtcatggcgccccggaccctcatcctgctgctctcgggagccctggccctgaccgagacctgggccggtgagtgcggggttgggagggaatcggcctcttgcggagaggagcgaggggcccgcccggcggagggcgcaggacccggggagccgcgcagggaggagggtcgggcgggtctcagcccctcctcgccccaggctcccactccatgaggtatttctgcaccgctgtgtcccggcccggacgcggggagccccacttcatcgccgtgggctacgtggacgacacgcagttcgtgcggttcgacagcgacgacgagagtccgagaggggagccgagggcgccgtgggtggagcggaaggggccggagtattgggaccgggagacacagaagtacaagccccaggcacagactgaccgagtgagcctgcggaacctgcgcggctactacaaccagagcgaggccggtgagtggaccccggcccggggcgcaggtcacgacccctcctcatcccccacggacggcccgggtcgccccaagtctcccggtctgagatccaccccgaggctgcggaacccgagaccctcgaccggagagagccccagtcacctttacccggtttcattttcagtttaggccaaaatccccgcgggttggtcggggcggggcggggctcgggggacggggctgaccgcgggggcgggccagggtctcacatcatccagaggatgtatggctgcgacgtggggcccgacgggcgcctcctccgcgggtatgaccagcacgcctacgacggcaaggattacatcgccctgaacgaggatctgcgctcctggaccgccgcgaacacggcggctcagatcacccagcgcaagtgggaggcggcccgtgaggcggagcagctgagagcctacttggagggcctgtgcgtggagtggctccgcagatacctgaagaatgggaaggagacgctgcagggcgcgggtaccaggggcagtgggagcgttccccatctcctgtagatctcccgggatggcctcccacgaggaggggaggaaaatgggatcagcgctagaatatcgccctcccttgaatggagaatgggatgagttttcctgagtttcctctgagggccccctctgctctctgaggacaattaagggatgaagtccttgaagaaatggaggggaagacagtccctagaatactcatcaggggtcccctttgaccactttgaccactgcagcagctgtggtcaggctgctgacctttctctcaggccttgttctctgcctcacgctcaatgtgtttgaaggtttgattccagcttttctgagtccttcggcctccactcaggtcaggaccagaagtcgctgttcctccctcagagactagaactttccaatgaataggagattatcccaggtgcctgtgtccaggctggcgtctgggttctgtgcccccttccccaccccaggtgtcctgtccgttctcaggatggtcacatgggcgctgttggagtgtcgcaagagagatacaaagtgtctgaattttctgactcttcccgtcagaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatggggtaaggagggggatgaggggtgatgtgtcttctcagggaaagcagaagtcctggagcccttcagccaggtcagggctgaggcttgggggtcagggcccctcaccttcccctcctttcccagagccgtcttcccagcccaccatccccatcgtgggcatcgttgctggcctggctgtcctggctgtcctagctgtcctaggagctgtggtggctgttgtgatgtgtaggaggaagagctcaggtagggaaggggtgaggagtggggtctgggttttcttgttccactgggagtttcaagccccaggtagaagtgtgccccacctcgttactggaagcaccatccacacatgggccccatcccagcctgggaccctatgtgccagcacttactctgttgtgaagcacatgacaatgaaggacagatgtatcaccttgatgattatggtgttggggtccttgattccagcattcatgagtcaggggaaggtccctgctaaggacagaccttaggagggcagttgctccaacaaccacagctgctttccccgtgtttcctgatcctgccctgggtctgcagtcatagttctggaaacttctcttgggtccaagactaggaggttcccctaagatcgcatggccctgactcctccctgtcccctcacagggcattttcttcccacaggtggaaaaggagggagctgctctcaggctgcgtgtaagtgatggcggtgggcgtgtggaggagctgctctcaggctgcgtgtaagtgatggcggtgggcgtgtggaggagctcacccaccccataattcctcttgtcccacatctcctgcgggctctgaccaggtctttttttttgttctaccccagccagcaacagtgcccagggctctgatgagtctctcatcgcttgtaaaggtgagattctggggagctgaagtggtcgggggtggggcagagggaaaaggcctaggtaatggggatcctttgattgggacgtttcgaatgtgtggtgagctgttcagagtgtgatcacttaccatgactgacctgaatttgttcatgactattgtgttctgtagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccaccccctgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaagctttccagaatccgcatgttctctgtggctgagtctgttgcaggtgggggtggggaaggctgtgaggagccgagtgtggacgggggcctgtgcctagttgctgttcagttcttcatgggctttatgtagtcagtccttagctgggtcaccttcactgctccattgtccttgtcccttcagtggaaacttgtccagcaggagc

SEQ ID NO: 4089 - DNA, 1098 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtga

SEQ ID NO: 4090 - DNA, 1101 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 4091 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 4092 - DNA, 1089 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgccgctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 4093 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 4094 - DNA, 1089 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcattggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 4095 - DNA, 2157 bp, Homo sapiens
atgaattatcaaagaattaagaattattgtaaatttacaagcgtttttctattttttttgttttcctgtgtttctaatgagttaaagttagatcaaagtttggtaaaaggaaaacttgtcaatgggctaaggtattatatttataaaaatcaaaccccaaagaatgccgttaatatgggaattgtttttaatgtgggctcacttaatgaagaagataatgagaggggaatagcgcattatcttgaacatatggcttttaatggtacaaaagattatccagggaattctatagttgatgttcttaaaaaatttggaatgcaatttggtgctgacattaatgctgctactagttttgatttcacttattatagacttgatttgtcagatggtaataataaagatgaaattgatgaatctataaatattttgagaaactgggcttctcaaatcagtttcatgaaagaagaaatagatctagagcgaaatattattattgaggaaaaaaagcttggtgagacttatcctggaagaatttatgagaaaatggataagtttttgacaagcggaagtctttatgaatttagaagtcctattggacttgaagagcaaattttatcttttcagccagaagattttaaaaaattttatagaaagtggtataggccagaacttgcaagtgttattgtggtaggagatattgatcctatagaaattgaagagaagataaagaagcaatttgtttcttggaaaaatccaaccgataaaattaaagaagtaaaagtaagtttagacgtagagcttaaggataaatttttacttttagaagatttggaagttggagagcctagtttaatgttctttaaaaaggaaattattaactttgtaaagaccaaagatgaccttttaaatgctattaaaaagtctttattagccgctctttttgaaaatagattttctgaattaaagactgctggggtaaagcaatttaaaaatgtttcaaataaagattttttctcatttaaatcagataacaataccattgttgcaaaatcgatttctttaaactttaatccagatcatttgaacgaaggaatacaagactttttttatgagcttgagaggataagaaaatttggatttacccaaggtgagcttgaaaaagttagatctcaattttacaaatctttagaattaaggaaaaagaatataaataaaacaaattcatgggctatttttcaggatttaatagaaattgctattaatggttctaataaatttgatatgaatgaatattgcgatctttcttttcaatatttggaaaagattgatttaaaaacaataaacaatcttgtaggaagagagtttgatgtaaaaaattgtgcaattttttattcttaccatggaagagcacatcctgttttaactcttgaagatattgacaatcttcaaaagatagctttaaaaagagagttaaagccttatgagaattctttaattgaaggtaaattttttaagaagtctttagatgataaagatattattagagaaaatgagtttgaaaatgaaatttcgtcatttgttcttgaaaatggggttgaagtttattttaaatataatgatcaaaaaaaaggtgtaattgattttagtgcaacttcttggggaggtttaattaatgaagatttaaaacttattcctgttttatcttttgctcccggagtagtatctggttcgggttatggtgattattctgcattacagattgaaaaatatttatcagataaagctgtttctttaagagttggggttggagctcaagaatcatatatttctggaagttcagataaaaaagatcttgaaactctttttcagcttatatattttacttttaaggaacccaaaattgatgatgtttctttgcaaaatgctattaataatataaaagcattaataaagagcaatgaaaatagttctgattatcattttcataaagccattagtaaatttttaaacaataatgatcctagatttgaagatacaaaagatagtgatttgcaatattttacaaaagaaaatattttgtctttttataagaaaaggtttacttatgcaaataattttaagtttgtcttgctggagactcagatattcagacaataa

SEQ ID NO: 4096 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagaagtacaagcgccaggcacagactgaccgagtgagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4097 - DNA, 9028 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcgtacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagaccggttctgaggaaggaagcacaggccccatctgcaagcctcagtgtcagtgtgagatactgccaacctctggggaagagtgatgtctttgcctccaggggtgggaaaggcatagcatggggtaggcctctt

SEQ ID NO: 4098 - DNA, 9028 bp, Homo sapiens; identical to SEQ ID NO: 4097

SEQ ID NO: 4099 - DNA, 9028 bp, Homo sapiens; identical to SEQ ID NO: 4097

SEQ ID NO: 4100 - DNA, 4087 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacatccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccagggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagc

SEQ ID NO: 4101 - DNA, 3215 bp, Homo sapiens
ccgcgcgcctcgggccggattctcggcaccctgcgggggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttcctttgaagaaaatgtgagtgggaaacatgaagagtgatgaaatgaacaagttgagtgactcccaccctgttgaagagattgaacttcatccccagttcctgtgaagctttctggatctcgtcttccaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgttgtaaggatgcgaggcagcgggaggcagtgctggatgacggagacgccaaacgctttgttgtggcataatgtgtctggagttggttcctgccggtgggttcgtggtctcgctgacttcaaggatgaagccaccgactttcgcgttatgccacgggaccccagcctgcactgccatgtgacttcaaccgcatgagagaccctgggcccagagcactcagactcatgaacaaaatagattcagcattcccatatttgaaatgggaagaagtttcatgtccattctggcttcatgtggttggaagaggaagccccatgaatatttttatggatgccccagtgctgttgagtgcctatcaacaccaccacgagcttggccacttcacatcaacagcagatttaatttgggatctctaaacactatttgtggttgtgtagacagaaagaatttttctaataaaataaaaattaaatgtg

SEQ ID NO: 4102 - DNA, 4092 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 4103 - DNA, 3215 bp, Homo sapiens; identical to SEQ ID NO: 4101

SEQ ID NO: 4104 - DNA, 3215 bp, Homo sapiens; identical to SEQ ID NO: 4101

SEQ ID NO: 4105 - DNA, 4087 bp, Homo sapiens; identical to SEQ ID NO: 4100

SEQ ID NO: 4106 - DNA, 1882 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccacccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggagggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 4107 - DNA, 1802 bp, Homo sapiens
ggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaatgtcagttgcaatattcctgtggtgtctggcaaagaatgtgaggaaattatcaggaaaggaggtgaaacatctgaaatgtatctcattcaacctgacagttctgtcaaagatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagact

SEQ ID NO: 4108 - DNA, 1839 bp, Homo sapiens
ggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaattgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 4109 - DNA, 1949 bp, Homo sapiens
ttgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaaaaaaaaaaaaa

SEQ ID NO: 4110 - DNA, 2543 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgaatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaa

SEQ ID NO: 4111 - DNA, 3693 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctcc

SEQ ID NO: 4112 - DNA, 8878 bp, Homo sapiens
gaattcatgccccttttgaaatagacttatgtcattgtcagaaaacataagcatttatggtatatcattaatgagtcacgattttagtggttgccttgtgagtaggtcaaatttactaagcttagatttgttttctcacatattctttcggagcttgtgtagtttccacattaatttaccagaaacaagatacacactctctttgaggagtgccctaacttcccatcattttgtccaattaaatgaattgaagaaatttaatgtttctaaactagaccaacaaagaataatagttgtatgacaagtaaataagctttgctgggaagatgttgcttaaatgataaaatggttcagccaacaagtgaaccaaaaattaaatattaactaaggaaaggtaaccatttctgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggaggtgaattttttaaagcattattatattattagtagtattattaatataagatgtaacataatcatattatgtgcttattttaatgaaattagcattgcttatagttatgaaatggaattgttaacctctgacttattgtatttaaagaatgtttcatagtatttcttatataaaaacaaagtaatttcttgttttctagtttatcacctttgttttcttaagatgaggatggcttagctaatgtaagatgtgtttttctcacttgctattctgagtactgtgattttcatttacttctagcaatacaggattacaattaagaggacaagatctgaaaatctcacaaactataaaataataaaagagcagaattttaagataaaagaaactggtggtaggtagattgttctttggtgaaggaaggtaatatatattgttactgagattactatttataaaaattataactaagcctaaaagcaaaatacatcaagtgtaatgatagaaaatgaaatattgcttttttcagatgaaaagttcaaattagagttagtgtgtattgttattattaatagttatgaaacacggttcagtctaatttatttatttgtagaacagtttgtcctcaactattatttttgctgacttattgctgttaatttgcagttactaaaaatacagaaatgcatttaggacaatggatatttaagaaatttaaattttatcatcaaacgtatcatggccaaatttcttacatatagcatagtatcattaaactagaaataagaatacacaataatatttaaatgaagtgattcatttcggatcattattgagtttcaagggaacttgagtgttgtacttatcagactctacatgtaagaacatatagttaatctggttgtgtgtgtaaaaacatatggttaatctggttaagtctggttaatcatattaggtaagaaaaatgtaaagaatgtgtaagacgaaatttttgtaaagtactctgcaaagcactttcacatttctgcttatcaactaaacctcacagagatagtttaatagtttaggctttaaaatggattttgattattcaacaagtggccttcataatttctttaagtgtttttctttaagtatatactttctttaaatattttttaaaatttccttttctctagtaaagccagaccatccatgctacctctctagtggcactctgaaataaaaagaaaatagttttctctgttataattgtatttgtaataagcagatgaatcacatttcttaaaatttgttttagagagggtaagctctgactaggaccatgacttcaatgtgaaatatgtatatatcctccgaatctttacatattaagaatgtatatagtcaactggttaaacaggaaaatctggaacagcctggctgggttttaatcttagcaccatcctactaaatgttaaataatattataatctaatgaataaatgacaatgcaattccaaatagagttcatctgatgacttctagactcacaaaattgcaagagagctcagttgttgctcagttgttccaaatcatgtcgtttgttaatttgtaattaagctccaaaggatgtatagctactgacaaaaaaaaaaatgagaatgtagttaatccaaatcaaaactttcctattgcaatgcgtattttctgcttcattatcctttaatataatattttaagttagcaagtaattttaattacaatgcacaagccttgagaattattttaaatataagaaaatcataatgtttgataaagaaatcatgtaagaaatttcaagataatggtttaacaaataattttgttgatagaagataagactaaaagtgaaattcgaagtggagaggacacttaaactgtagtacttgttatgtgtgattccagtaaaaatagtaatgagcacttattattgccaagtactgttctgagggtaccatatgcaataagttatttaatccttacaataatcttgtaaggcagattcaaactatcattacacttattttacagatgagaaaactggggcacagataaagcaacttgcccaaggtctcatagctgtaagtcaaccctacggtcaagacctacaagtagccgagctccagagtacattatgagggtcaaagattgtcttattacaaataaattccaagtagaatcaacctttaataagtctttaatgtctcttaaatatgtttatataggagtctaatcaccaattcacaaaaatgaaagtagggaaatgattaacaataatcataggaatctaacaatccaagtggcttgagaatattcattcttcttgacagtatagattctttacaatttcgtaagttccaatgtatgttttaggaatatgaggtcattactattcataatctgatacagctttatcctaaggcctctctttaaaaactacactgcatcatagcttttttgtgcagttggtctttctactgttactgaacagtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctggtgggtgcactgatgtttcttgcagtggtggctctctcatgcagagaaagcctgtagtcatggcagtctgctaatgtttcactgacccacattaccatcactgttattttgtttgtttattttggaaataaaattcaaaacataaacatattgggcctttggtttaggctttctttcttgttttctttggtctgggcccaaaatttcaaattaggatatgtgggtgccacctttccatttgtattttgccactgcctttgtttagttggtaaaattttcatagcccaattatattttttctggggtaagtaatattttaaatctctatgagagtatgatgatgactttcgaatttctggtcttacagaaaaccaaataataaatttttatgttggctaatcgtatcgctgaattttcctatgtgctattttaacaaatgtccatgacccaaatccttcatctaatgcctgctattttctttgtttttagggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctataaaattggaaccgttagactgccacgagaatgcatggttgtgagaagattaacatttctgggttagtgaatagcattcatacgcttttgggcaccttcccctgcaacttgccagataagcactattcagctcttattcccagtctgacatcagcaagtgtgattttctatgaaaaattctactatgactccttattttaagtatacaagaaacttgtgactcagaagataatatttacagagtggaaaaaaacccctagcatttatagttttaacatttgaggttttgaatgagagagttatccataatatattcaattgtgttgtggataatgacacctaacctgtgaatcttgaggtcagaatgttgagtgctgttgacttggtggtcaggaaacagctagtgcgtgagcctggcacaggcatctcagtgagtagcatacccacagttggaaatttttcaaagaaatcaaaggaatcatgacatcttataaatttcaaggttctgctatacttatgtgaaatggataaataaatcaagcatatccactctgtaagattgaacttctcagatggaagaccccaatactgctttctcctcttttccctcaccaaagaaataaacaacctatttcatttattactggacacaatctttagcgtatacctatggtaaattactagtatggtggttaggatttatgttaatttgtatatgtcatgcgccaaatcatttccactaaatatgactatatatcataactgcttggtgatagctcagtgtttaatagtttattctcagaaaatcaaaattgtatagttaaatacattagttttatgaggcaaaaatgctaactatttctacataatttcatttttccagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcataatgacattacagtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagtaaaatgaaaatctaatatttgttatattattttcaaaggtctataataacacactccttagtaacttatgtaatgttattttaaagaattggtgactaaatacaaagtaattatgtcataaacccctgaacataatgttgtcttacatttgcagaatgtgaggaaattatcaggaaaggaggtgaaacatctgaaatgtatctcattcaacctgacagttctgtcaaaccgtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctacaaaaaaaaaaaaaataccaaaaaaaaaaaaaaaatcagctgtgttggtagtatgtgcctgtagtcccagctatccaggaggctgagatgggagatcacctgagcccacaacctggagtcttgatcatgctactgaactgtagcctgggcaacagaggatagtgagatcctgtctcaaaaaaaaaaattaattaaaaagccaggaaacaagacttagctctaacatctaacatagctgacaaaggagtaatttgatgtggaattcaacctgatatttaaaagttataaaatatctataattcacaatttggggtaagataaagcacttgcagtttccaaagattttacaagtttacctctcatatttatttccttattgtgtctattttagagcaccaaatatatactaaatggaatggacaggggattcagatattattttcaaagtgacattatttgctgttggttaatatatgctctttttgtttctgtcaaccaaaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcaaaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagagattttattttgtttttcttttaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggtatgtgtggcactctttgctcctgctttaaaaatcacactaatatcattactcagaatcattaacaatatttttaatagctaccacttcctgggcacttactgtcagccactgtcctaagctctttatgcatcactcgaaagcatttcaactataaggtagacattcttattctcattttacagatgagatttagagagattacgtgatttgtccaatgtcacacaactacccagagataaaactagaatttgagcacagttactttctgaataatgagcatttagataaatacctatatctctatattctaaagtgtgtgtgaaaactttcattttcatttccagggttctctgatactaagggttgtaaaagctattattccagtataaagtaacaaacacagtccctagatggattgccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcacccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggctgaggcgggcggtcacaaggtcaggagttcaagaccagcctgaccaatatggtgaaaccccatctctactaaaaatacaaaaattagccaggcgtggtggcaggtgcctgtaggtcccagctagcctgtgaggtggagattgcattgagccaagatc

SEQ ID NO: 4113 - DNA, 1797 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 4114 - DNA, 1716 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 4115 - DNA, 1797 bp, Homo sapiens; identical to SEQ ID NO: 4113

SEQ ID NO: 4116 - DNA, 1797 bp, Homo sapiens; identical to SEQ ID NO: 4113

SEQ ID NO: 4117 - DNA, 1485 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacaccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagc

SEQ ID NO: 4118 - DNA, 598 bp, Homo sapiens
agacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaaaaaaaaa

SEQ ID NO: 4119 - DNA, 1605 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagtaataaagcatcttgctccctaaggcttcacaccatgaaatagccacagtgctgggggccgtcccaacgtgttctttcttccacagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagatcaagaccagcctgggcaacatagcaaaaccccatctctacaaaaaaatatacaacagttagccaggcatgatggcacatgtctgcagtcccagctacttgggaggctaaggtgggaggatcacttgagcccaggatgtcaaggctgcagtgagttatgatcacactgctgcactccagcgtgggtgacagagcaagaccctgtctcaaataaataaaaattaagtttctattaa

SEQ ID NO: 4120 - DNA, 1605 bp, Homo sapiens; identical to SEQ ID NO: 4119

SEQ ID NO: 4121 - DNA, 1512 bp, Homo sapiens
tcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagatcaagaccagcctgggcaacatagcaaaaccccatctctacaaaaaaatatacaacagttagccaggcatgatggcacatgtctgcagtcccagctacttgggaggctaaggtgggaggatcacttgagcccaggatgtcaaggctgcagtgagttatgatcacactgctgcactccagcgtgggtgacagagcaagaccctgtctcaaataaataaaaattaagtttctattaa

SEQ ID NO: 4122 - DNA, 1605 bp, Homo sapiens; identical to SEQ ID NO: 4119

SEQ ID NO: 4123 - DNA, 1450 bp, Homo sapiens
ccgctgcgcgcagccaggggccaacgagagccgacgctgggcgggcagcgtccgggagcccctccgaccctgcgctcccctcgtccgcgccctgaccccgcgtctccggccgtccagcccgcgccgcgtcacctcccctcccggagcgaagggccctgctcgcccgaggacggaggcccgcacgggacacggggccccagtttccgccccggaagcccaggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaagacctgaaaattgtt

SEQ ID NO: 4124 - DNA, 1009 bp, Homo sapiens
ggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaatgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaagacctgaaaattgtt

SEQ ID NO: 4125 - DNA, 1064 bp, Homo sapiens
cgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaagacctgaaaattaaaaaaaaaaaaaaaaaa

SEQ ID NO: 4126 - DNA, 1160 bp, Homo sapiens
ccgctgcgcgcagccaggggccaacgagagccgacgctgggcgggcagcgtccgggagcccctccgaccctgcgctcccctcgtccgcgccctgaccccgcgtctccggccgtccagcccgcgccgcgtcacctcccctcccggagcgaagggccctgctcgcccgaggacggaggcccgcacgggacacggggccccagtttccgccccggaagcccaggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaatgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaagacctgaaaattgtt

SEQ ID NO: 4127 - DNA, 1450 bp, Homo sapiens; identical to SEQ ID NO: 4123

SEQ ID NO: 4128 - DNA, 1450 bp, Homo sapiens; identical to SEQ ID NO: 4123

SEQ ID NO: 4129 - DNA, 2579 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 4130 - DNA, 2459 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 4131 - DNA, 773 bp, Homo sapiens
ggtgcgacgctgctgccgaggaaaaccttgtattattaggcatggtcaaccccaccgtgttcttcgacattgccatcgacggcgagcccttgggccgcgtctccttttagctgtttgcagacaagttcccaaagacagcagaaaattttcgtgctctgagcactggagagaaaggatttagttataagggttcctgctttcacagaattattccagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataagtttgacttgtgttttatcttaaccaccagaccattccttctgtagttcaggagaacacccttccaccccatttgctcgcagtatcctagaatctttgtgctcttgctgcagttccatgttttccttgttccctcccatgcctagctggattgcagagttaagtttatgattatgaaataaaaaccaaataacaaaaaaacaagaaaagaaaaaaaaaaaaaaaaaaaaaaaaa

SEQ ID NO: 4132 - DNA, 2459 bp, Homo sapiens; identical to SEQ ID NO: 4130

SEQ ID NO: 4133 - DNA, 2526 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 4134 - DNA, 1796 bp, Homo sapiens
ggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcat

SEQ ID NO: 4135 - DNA, 2459 bp, Homo sapiens; identical to SEQ ID NO: 4130

SEQ ID NO: 4136 - DNA, 2561 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagtgacggcgctggcgggggaggcgctcttgagcccctcccgattgtccctctgcctagcaagcaagttgcgactggccacaaggcaggcctcttccgaccaagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 4137 - DNA, 2579 bp, Homo sapiens; identical to SEQ ID NO: 4129

SEQ ID NO: 4138 - DNA, 2616 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 4139 - DNA, 540 bp, Homo sapiens
atgagcggagtgtgggaaggaaggagccctgtagtatcagccatagtcaatcccacggtgttcttcaacattgccatcaatggtgagcccttgggctgcatctcctttgagctgtttgcagacaagtttccaaagacagcagaaaaccttcgtgttctgggcatgggagagaaaggatttggttgtaagggctcccgctttcacagaattattccagggtttatgtgtcagggtggtgacttcacacgccataatggcactggtggcaagtccatctatggggagaaatttgatgatgagaacttcatcctaaagcatacaggtcctggcatcttgtccatggcaaatgctggacccaacacaaacggttcccagtttttcatctgcactgccaagagtgagtggttggatggcaagcatgtggtctttggcaagatgaaagaaggcataaatattgtggaggccacggggcgctttgggtccaggaatggaaagaccagcaagaaaatcaccattgctgactgtggacaacttgaataa

SEQ ID NO: 4140 - DNA, 2467 bp, Homo sapiens
cgcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaa

SEQ ID NO: 4141 - DNA, 2473 bp, Homo sapiens
cgcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcaggcaagtctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaa

SEQ ID NO: 4142 - DNA, 1488 bp, Homo sapiens
atggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttag

SEQ ID NO: 4143 - DNA, 1566 bp, Homo sapiens
cccgcggccccgcccgcctccgcctccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgatgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatt

SEQ ID NO: 4144 - DNA, 5144 bp, Homo sapiens
cggtgcggaccggggccgcgcggcgtggcgcggggagcggcggcggcggcagagccagagcaacatggcgccggtgggcgggggcgggcgcccggtcggcggaccggcccgcgggcgcctcctcctggcggcgccggtgctgctggtgctgctgtgggcgctgggggcccggggccagggcagcccccagcagggcacgatcgtgggcatgaggctggcgagctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaacttgcctgtttgttctgtcagtattcagtatgttgttgagataaaagtggctgtggctggctgtctcttgtgatgggacaagggcaataaaggattctaggaccattcagcagtgaaatgcaatcagaaatggaatttctaaatatagtcaaggctgtcgtcacaggagtgagagggacgtggctgctggcagacatacaggacagatgtgctcagctgccataagcatgagtcctgtgaaacagatcccatagggcccttggcttgtgagtactggaagggcagtgggcttcagcaaattgcccctcctccctacccatgggactgaaagaagcttgatccaaaagtatgagtaatattgttttataacatgcagct

SEQ ID NO: 4145 - DNA, 4559 bp, Homo sapiens
catgaggctggcgagctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaaaaaaaaaaaaaaaaaaa

SEQ ID NO: 4146 - DNA, 4555 bp, Homo sapiens
agggcggagccttaggcggagcgaagagaaccggtcgcggcaatcctagcgcgcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacacggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaacagtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctcaccccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaaacgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttatcacatacagcaaattcctttttttttctttttctatgagcacattctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaggatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgatcgctctatatgatcatgttaatttaaagctttatacacataaaaaaaaaaaaaaaaaaaaaaaaaaaaaaaaaaaaaaaaaaaaaaaaaaaaaaaaaaaaaaaaa

SEQ ID NO: 4147 - DNA, 3436 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgctaaacccagtccttctttcttccctaggggtatctagcttcatcaccatcatagaaggtagaaaaagatggaatcacagggtcaaagcacagcttctctacctaccctaccaaacagtacatattcacttaccccaccaggtttttctcaactccaaatactgctttaggttaagtgtattctgctgccaagggaagcataggtttgagtctaaacaggctctgaaacagattgtgcaaaacctcaggcctccttccttcctcgggaagttccaactgtggcagaaatgaagatggaacttctcaagaataaacagttttggccgggtgtggtggctcacgcctgaaatcccagcactttgggaggccaaggtgggctgatcacatgaggccaggagttcgagaccagcctggccaatatggcaaaaccccatctctactaaaaatataaaaatgagacgggcatggtggcacacacctgtaatcctagctactcaggaggctgaggcacgagagtcgcttgaacccaaaaggcagagtttgcagtgagccaagatcatgccactgcactccagcctgggtgacagagtgagactctgtctcaaaaataaataaatagtttctagcactcatcccctagatatcccccaagtgtctctcttcccctttggtcaaggttataactgggataatgattatgacagactggctgggtgtcagaggtacagatttaaggtagatggactcagggtaaggatagctacagctgtgtggggctgaaggtctgtggcactgagctactggggaaggagggctctgttttcattttgacacactgagttaataaagcacttactgagggagccagagcccaaactctaaatgtgctgtagaaaaagggccaagtcattgactgcaccactccttcagccagagg

SEQ ID NO: 4148 - DNA, 3566 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgctaaacccagtccttctttcttccctaggggtatctagcttcatcaccatcatagaaggtagaaaaagatggaatcacagggtcaaagcacagcttctctacctaccctaccaaacagtacatattcacttaccccaccaggtttttctcaactccaaatactgctttaggttaagtgtattctgctgccaagggaagcataggtttgagtctaaacaggctctgaaacagattgtgcaaaacctcaggcctccttccttcctcgggaagttccaactgtggcagaaatgaagatggaacttctcaagaataaacagttttggccgggtgtggtggctcacgcctgaaatcccagcactttgggaggccaaggtgggctgatcacatgaggccaggagttcgagaccagcctggccaatatggcaaaaccccatctctactaaaaatataaaaatgagacgggcatggtggcacacacctgtaatcctagctactcaggaggctgaggcacgagagtcgcttgaacccaaaaggcagagtttgcagtgagccaagatcatgccactgcactccagcctgggtgacagagtgagactctgtctcaaaaataaataaatagtttctagcactcatcccctagatatcccccaagtgtctctcttcccctttggtcaaggttataactgggataatgattatgacagactggctgggtgtcagaggtacagatttaaggtagatggactcagggtaaggatagctacagctgtgtggggctgaaggtctgtggcactgagctactggggaaggagggctctgttttcattttgacacactgagttaataaagcacttactgagggagccagagcccaaactctaaatgtgctgtagaaaaagggccaagtcattgactgcaccactccttcagccagagg

SEQ ID NO: 4149 - DNA, 3436 bp, Homo sapiens; identical to SEQ ID NO: 4147

SEQ ID NO: 4150 - DNA, 4832 bp, Homo sapiens
cagtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatca

SEQ ID NO: 4151 - DNA, 2408 bp, Homo sapiens
acacagttagaggtcccgggcgcacctgcagagccggaggcgtgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaacccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcagcattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcgatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatcacgaggaaaagaagtgctttcctaagggggtggacatgatggctgcccttgatctctacttccagctgtgttctgtggaggtcacttgtgaatcaggcagtgtcatggcagccaccctcgccaacggtgggatttgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaaaaaaaaaaaaaaaaaa

SEQ ID NO: 4152 - DNA, 3719 bp, Homo sapiens
tcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatca

SEQ ID NO: 4153 - DNA, 4778 bp, Homo sapiens
cagtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatca

SEQ ID NO: 4154 - DNA, 2636 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcaaaaaaaaaaaaaa

SEQ ID NO: 4155 - DNA, 2311 bp, Homo sapiens
tggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgggcatctgtttttcattttgcctgtggtttgtgttgcaggtgttgatagttgttttaaggattgttaggtataggaaatccagtaaattaataaaaaaattttgattttccaat

SEQ ID NO: 4156 - DNA, 4883 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 4157 - DNA, 4816 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 4158 - DNA, 4778 bp, Homo sapiens
gcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaattttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 4159 - DNA, 4826 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagctctgtgatttctgccctgcagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 4160 - DNA, 4633 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 4161 - DNA, 3001 bp, Homo sapiens
cttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4162 - DNA, 4788 bp, Homo sapiens
ggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacgcgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggt

SEQ ID NO: 4163 - DNA, 4788 bp, Homo sapiens
ggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacgcgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggt

SEQ ID NO: 4164 - DNA, 3504 bp, Homo sapiens
gagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaaaaaaaaaaaaaaaaaaaaaaaaaaaaaaaaaaac

SEQ ID NO: 4165 - DNA, 3317 bp, Homo sapiens; identical to SEQ ID NO: 3960

SEQ ID NO: 4166 - DNA, 4296 bp, Homo sapiens
ggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaacgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaa

SEQ ID NO: 4167 - DNA, 2858 bp, Homo sapiens
gccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccagctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgaccgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagccgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcggaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtca

SEQ ID NO: 4168 - DNA, 3908 bp, Homo sapiens
ggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggatattgtgggcactctgaggccagatgagaaggccatcatgacttacgtgtcctgcttctaccacgctttctcgggggctcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaacgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggata

SEQ ID NO: 4169 - DNA, 2869 bp, Homo sapiens
gcggagcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccggctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgactgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagctgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcagaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtctc

SEQ ID NO: 4170 - DNA, 3386 bp, Homo sapiens
gagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaacgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaacc

SEQ ID NO: 4171 - DNA, 3226 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggtgaggaggggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 4172 - DNA, 915 bp, Homo sapiens
aaagacaaaaactagccttttggctctctgaccagcaccatggcggttggcaagaacaagagccttacgaaaggcggcaaaaagggagccaagaagaaagtggttgatccgttttctaagaaaaattggtatgatacgaaagcacctgctatgttcaatatatgaaatattggaaagatgctggtcaccaggacccaaggaaccaaaattgcatctgatgatctcaagggtcatgtgtttgaagtgagtcttgctgatttgcagaatgatgaagttgcatttagaaaattcaagctgattactgaagatgttcagggtaaaaactgcctgactaacttccatggcatggatcttacccgtgacaaaacgtgttccatggtcaaaaaatggcagacaatgattgaagctcatgttgatgtcaagactaccgatggttacttgcttcatctgttctgtgttggttttaataaaaaacgcaacaatcagatatggaagacctcttatgctcagcaccaacaggtccgccaaatccggaagaagatgatggaaatcacgacccgagaggtgcagactaatgacttgaaagaagtggtcaataaattgattccagacagcattggaaaagacatagaaaaggcttgccaatctatttatcctctccgtgatgtcttcgttagaaaagtaaaaatgctgaagaagcccaagtttgaattgggaaggctcatggagcttcatggtgaaggcagtagttctggaaaagccactggggatgagacaggtgctaaagttggacgagctgatggatatgaaccaccagtccaagaatctgtttaaagttcagacttcaaatagtggcaaataaaaagtgctatttgtgaaaaaaaaaaaaaaaaaaaaaaaaagacaaaaactaat

SEQ ID NO: 4173 - DNA, 939 bp, Homo sapiens
gggcatggtggctcacacctgtaatcccagcactttgggaggctgggatgggtggatcacctgaggtcaggagttcaagaccacaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctg

SEQ ID NO: 4174 - DNA, 866 bp, Homo sapiens
gggcatggtggctcacacctgtaatcccagcactttgggaggctgggatgggtggatcacctgaggtcaggagttcaagaccacaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtgaaccaccagtccaagaatctgtttaaagttcagacttcaaatagtggcaaataaaaagtgctatttgtga

SEQ ID NO: 4175 - DNA, 857 bp, Homo sapiens
ggctctctgaccagcacatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaa

SEQ ID NO: 4176 - DNA, 905 bp, Homo sapiens
actagccttttggctctctgaccagcaccatggcggttggcaagaacaagagccttacgaaaggcggcaaaaagggagccaagaagaaagtggttgatccgttttctaagaaaaattggtatgatacgaaagcacctgctatgttcaatatatgaaatattggaaagatgctggtcaccaggacccaaggaaccaaaattgcatctgatgatctcaagggtcatgtgtttgaagtgagtcttgctgatttgcagaatgatgaagttgcatttagaaaattcaagctgattactgaagatgttcagggtaaaaactgcctgactaacttccatggcatggatcttacccgtgacaaaacgtgttccatggtcaaaaaatggcagacaatgattgaagctcatgttgatgtcaagactaccgatggttacttgcttcatctgttctgtgttggttttaataaaaaacgcaacaatcagatatggaagacctcttatgctcagcaccaacaggtccgccaaatccggaagaagatgatggaaatcacgacccgagaggtgcagactaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaggctcatggagcttcatggtgaaggcagtagttctggaaaagccactggggatgagacaggtgctaaagttggacgagctgatggatatgaaccaccagtccaagaatctgtttaaagttcagacttcaaatagtggcaaataaaaagtgctatttgtgaaaaaaaaaaaaaaaaaaaaaaaaagacaaaaactaat

SEQ ID NO: 4177 - DNA, 793 bp, Homo sapiens
gggcatggtggctcacacctgtaatcccagcactttgggaggctgggatgggtggatcacctgaggtcaggagttcaagaccacaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtaacttcaaatagtggcaaataaaaagtgctatttgt

SEQ ID NO: 4178 - DNA, 888 bp, Homo sapiens
aagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagagattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctg

SEQ ID NO: 4179 - DNA, 903 bp, Homo sapiens
aagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctg

SEQ ID NO: 4180 - DNA, 903 bp, Homo sapiens; identical to SEQ ID NO: 4179

SEQ ID NO: 4181 - DNA, 856 bp, Homo sapiens
aagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaatgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttg

SEQ ID NO: 4182 - DNA, 899 bp, Homo sapiens
aatcgctttttggctctctcaccagcaccatggctgttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcgtctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttgtaaaaaaaaaaaaaaaaaaaaatcccagcatttc

SEQ ID NO: 4183 - DNA, 829 bp, Homo sapiens
cgctttttggctctctcaccagcaccatggctgttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcgtctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtcttctttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttg

SEQ ID NO: 4184 - DNA, 3747 bp, Homo sapiens
gcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatttatgttcatgactgttcatttaattacttctgactgtcttcctccagaagagaaagaccgtgtctaaatatattatcctg

SEQ ID NO: 4185 - DNA, 3666 bp, Homo sapiens
aaggatgggaagccgagcagacggccccagaacaagcggtcatgtgactgggaagatggccgcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatttatgttcatgactgttcatttaattacttctgactgtcttcctccagaagagaaagaccgtgtctaaatatattatcctg

SEQ ID NO: 4186 - DNA, 3611 bp, Homo sapiens
aaaaaaaaaaaaaagggcggccgctcgcgatctagaactagtcgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagaaaaaaaaaaaaaaaaaa

SEQ ID NO: 4187 - DNA, 1251 bp, Homo sapiens
gttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 4188 - DNA, 723 bp, Homo sapiens
atggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaa

SEQ ID NO: 4189 - DNA, 723 bp, Homo sapiens; identical to SEQ ID NO: 4188

SEQ ID NO: 4190 - DNA, 1251 bp, Homo sapiens; identical to SEQ ID NO: 4187

SEQ ID NO: 4191 - DNA, 1743 bp, Homo sapiens
cccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttccttttttgataaattgtactatgccagagctgtcaggaaccttccagatagcagtagaggactgcagctgtctaggtctgcggccacatcttggggacacactgggactgttcccatgtgcagggttcagcagttatgtgggagtgctaggggttaggcttttgagcttgaacgcctggcgtgtgaacagatgaaaaatccttcagtacccaagtcccagtctgtcctatggggagcagtttgggggcggccggcagcaggagcctgggaaagaggccctcgccaggtgatggcagggccagggtggcctgaggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaatggaattccaaacacttaacacattcagctatatgacagaaagtaaatctatggatatggtattttgtgaatg

SEQ ID NO: 4192 - DNA, 1743 bp, Homo sapiens; identical to SEQ ID NO: 4191

SEQ ID NO: 4193 - DNA, 1773 bp, Homo sapiens
cccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttccttttttgataaattgtactatgccagagctgtcaggaaccttccagatagcagtagaggactgcagctgtctaggtctgcggccacatcttggggacacactgggactgttcccatgtgcagggttcagcagttatgtgggagtgctaggggttaggcttttgagcttgaacgcctggcgtgtgaacagatgaaaaatccttcagtacccaagtcccagtctgtcctatggggagcagtttgggggcggccggcagcaggagcctgggaaagaggccctcgccaggtgatggcagggccagggtggcctgaggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 4194 - DNA, 1857 bp, Homo sapiens
cccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttccttttttgataaattgtactatgccagagctgtcaggaaccttccagatagcagtagaggactgcagctgtctaggtctgcggccacatcttggggacacactgggactgttcccatgtgcagggttcagcagttatgtgggagtgctaggggttaggcttttgagcttgaacgcctggcgtgtgaacagatgaaaaatccttcagtacccaagtcccagtctgtcctatggggagcagtttgggggcggccggcagcaggagcctgggaaagaggccctcgccaggtgatggcagggccagggtggcctgaggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 4195 - DNA, 1917 bp, Homo sapiens
cccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttccttttttgataaattgtactatgccagagctgtcaggaaccttccagatagcagtagaggactgcagctgtctaggtctgcggccacatcttggggacacactgggactgttcccatgtgcagggttcagcagttatgtgggagtgctaggggttaggcttttgagcttgaacgcctggcgtgtgaacagatgaaaaatccttcagtacccaagtcccagtctgtcctatggggagcagtttgggggcggccggcagcaggagcctgggaaagaggccctcgccaggtgatggcagggccagggtggcctgaggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 4196 - DNA, 2546 bp, Homo sapiens
gacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 4197 - DNA, 2525 bp, Homo sapiens
aggggttcctctcggagcggagacggcaaatggcggacttcgacacctacgacgatcaggcctacagcagcttcggcagcggcagagggtcccgcggcagtgctggtggccatggttcccgtagccagaaggagttgcccacagagcccccctacacagcatacgtaggaaatctacctttcaatacggttcggggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcggagatggccctcccctcggtggatccaacatggatttcagagaacccacagaagaggaaagcgcacagagaccacgactccagcttaaacctcgaacagtcgcgacgcccctcaatcaagtagccaatcccaactctgctatcttcgggggtgccaggcctagagaggaagttgttcaaaaggagcaaaaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacacggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgaggctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaataaaaaataa

SEQ ID NO: 4198 - DNA, 4900 bp, Homo sapiens
  misc_feature (1)...(4900): n = A,T,C or G
agccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggnnnnnnnnnnnnnnnnnnnnaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccagtggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaagtttggtaattttcacaaagaaaaaacatctgcagtctctttccctggtggcctggcatggaagtggtgtaggacatgctgattaagacaaacacaattggctgggcatggtggctcacacctgtaatcccagcactttgggaggctgacgcaggtggattgcttgagtgcaggagttggagaccagcccgggcagcacagggagacccctgtctctacaaaaa

SEQ ID NO: 4199 - DNA, 2034 bp, Homo sapiens
gcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaaaaaaaaaaaaaaaaaa

SEQ ID NO: 4200 - DNA, 3035 bp, Homo sapiens
ctcctcagtccagccgccgcagaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgagcacaaccagcaatgtttgtgctttctaagagtcactgacttgagaggaaagaaaac

SEQ ID NO: 4201 - DNA, 4486 bp, Homo sapiens
cggccagcccctccccctcccgctgcacgcggcccgcgcccccaattcgcccgccgctgcacccggccacggccccccggcccacgcccggctccgggaggaaaaggccccgcccctatctgttggagccgcgaccccgcccccttcccgcccctccgaggctccatccaatagtgagcgtggctgggcgggacgccgaggctgtcgtgagggggtcctgaccaatggggaagcgtgccgggcctggtgggcggggcggcaaggccttgtcacgctcgggtccgtgtgaaaacgggggttccgagtgcaaagcaaagtttttttgtaaaccgtctgcaaaggcgggggggcgaagaaggcgcccgagaccgggccgagtgcagctgccgtggccgccgcctctctagctcctcagccatccgctcctcagtccagccgccgcagaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcaaccacagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcaggtgagccgggaaagtcgctgccgcaggtggttgggtttggggtgcccagagcctcgcctggccttcggcggggtggcccgcacgccccctgctgcccgagcgggcctgcgccgcgccgcccctgcctgctccctccccgtcctgcacacgccccgctgctgctccaggaaatcagaaccccctcagtcgggtgcaaggagccggcgacgcgtctggcatatttgtaggtgggggctgtgggtcagaccctaagaaaaagggtcaggaggtgatcatcatcccgctgcagtccacacccgcacttggctgtctttacaggctgcagcaactttgctggagacttgtctggttatggttataacagcgtcagaaatgcttcccaattcaattccttggccctcttgggaaacggagagaatccccaattcgtccccagtagttgggtgctggaaaccttgctctgccaaagtagttcttatgcccattgaactccgtttcataatatgcattcagagcgtgtaaaccctggttaaaggtttcttttatgaacagcagtgtatgcttcagctaattgatccctaatcctggaaatcatagatttaggacctgtctgggcatgtttaacattttcccaggacttttcataatcgtactgaactaaaagtgatggtaatttattcatcttatatttttagtggatgctttttatatttaacattaagtgctcttgaaggaaatttgaaaataaatgttgaaagaaaggagatggaaatgactcaaccagtgtcctactacccaagctcaatggtgcttaacaatttggtcttatttccttcacttacgtttatttaccttgtatcattataaattatgctacataattttccttttcgagtgcagaatatgaagttagtgaaattcaagttgtacattggaaaggtttaataagtaattggttttcctctcactccactcggcaaggtgttattccaaagaaaattaagtttctctggtgtgtaatttcaaaagatcaatactttttatctttttgaatacttttgatcaatactttttgaaaagatcaatacttttgatttaaaagttagtagggcaggtagtcatttagtttcaatttttctaataatctctgtgattattgatttttattgttgatttgtcagtttttaaacccccctaccaagaaacttttatattcataataaaagtttaaaagttaaaattggttttattctcaagcaattggcctcagtgacaaagagtgactagagagtgcccgagtgtcaaatcaggtattttgtattagtagacttattcctagctgcatttaattttggtgttagcattcaattttatgttttcctttgtatataccataaagtatagcagaatggttgcaggactccacccccatagaaaatatacactattttggagaggaggaggcaggagagtggttaggagggtgaagaagcagtatcacaatgacttaatttagccctggctattatgtcctggctcattcccagaatgtcaatttatattaaattgctctgagcacatttttttaattgtactttctgaaaaaattttcaccttcatcaccacttaaaaagaattagacaaggatgtttatataaacactttaaatgtatttgatataaaatttttatttctttgtagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgttcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttggtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatt

SEQ ID NO: 4202 - DNA, 1688 bp, Homo sapiens
gtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtatatacttacaaaaaaaa

SEQ ID NO: 4203 - DNA, 2029 bp, Homo sapiens
taaaccgtccttcacaccgcggactgcacaggcacaggctgaagcgctgtggtcccgcagggatcccctcgcctgggccgttgtgtgggcggactcgcgagggaggttcacgacgctctgccccgccccgcggcccctgagtgagtgcgcctggaggggcggagggcagggtgggcccgcacccagcgtggccatggatgatcccctcgcggccgccgagcgctgcaggcgagaagcgtgggccaaggcgtcagcagaccctgggcggcggctgtggaggaggccagcgtggagtacggctcggcccggtacctgctgctgtgcggcctgggcgggatgctgagctgcggctgacacacacggccatcgtgtccctgcacctggtcaagtgccgcatgcaggtggaccccggctggtacaagggcgtcctcagcggcttcggcgtgacggtgcacagcgacgggctgtgcggcctggctcgcggctgcgctcagaccttcttcggctactccctgcagggcttcttcaagttcggcctttacgaggtcttcaagatccgctccgcggagctcctgggcccagagaaagcctacgggtggagagccggcctgtaccttttcgcctgggccagcgccgagttcttccccgatgtctcgctggagcccatggaggcggtcaaggtccgcgtgcagacgcgaccgggctacgccagcaccctgcgagccacggcgtccaggatgtagggcgaggagggcctgtgggccttctacaagggcgtggcgccgctgtggctgaggcagatcccctacaccatgatgaagttcgcctgcttcgagcgcacggtagaggacctctacaggtatgccgtgcccaagccccagagccagtgcaccaaggccaagcagctgggcatcaccttcgtggcgtcttctgcgctgtcgtgtcccatcccgccgactccgtggtgtctgtgctgaacaaggagaagggcatcgcggccctgggcgtcctccgaagactggggttcacgggcgtgtggaagggcgtcgttgcgcgcatcggcctctttgcgcacatccccatgatcggcaccctcacggccctgcagtggtttatctatgacctggtcaaggtctatttcaagctgcctcgccctcccgtggctcaagcgcccgaacccctgaagaagaaaaagtaggtgtgaagttctgaaccgctctagccacagtgggtccacatttccgtcaagtggggaatcgcgtgcaaacaatgctagtgtgtaagatgttaacattttgggcagaggttacttaatatgcagtctgagttctctttaaatgactgcttctttttggcaactcaagaggattgcaaacatttcgtttgggggtttgaaccattatctttggggagttggcgtggttgctttaactcaatagcttttcagcaattaaaaggaaaaaatacttaacaggaagtaatgttaggtagtttagggtctctaggtgttatctcctttgattcgccctttctgtagagattatccaagcataactactgaatagcctgcaaatgaggttttaaggtcagcacaactatatggatggggaagaaagtgagattctggtacacggtgttcatctcaatagaaatcgggcacctattgaatagatgaatgactcatcgcatatttcctgttcatgtccattacaggtaaaaaattattaaaagttaaattgtgacttatactgcctgatagcttagaatgtattcactgttttcaaagagacatgagaagatctgcattttctccttttgctttgtcccttctcttcctgatgttgctgattagaacatagctctctccaggaagtgctacaattggatcaatgtggaaagccagaaagagatgaagggcaggctctgggaataaatatgtaaagaaaagcctctgttctccagagatttcttttgtataactcagctttcaacagccatacatccaaagaagaccataccaccctgacat

SEQ ID NO: 4204 - DNA, 1983 bp, Homo sapiens
cgctgtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 4205 - DNA, 1786 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 4206 - DNA, 1983 bp, Homo sapiens; identical to SEQ ID NO: 4204

SEQ ID NO: 4207 - DNA, 1783 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 4208 - DNA, 1786 bp, Homo sapiens; identical to SEQ ID NO: 4205

SEQ ID NO: 4209 - DNA, 1783 bp, Homo sapiens; identical to SEQ ID NO: 4207

SEQ ID NO: 4210 - DNA, 4125 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaacccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaagctgg

SEQ ID NO: 4211 - DNA, 4202 bp, Homo sapiens
gcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccctgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaaaaaaaaaaaaaaaaaa

SEQ ID NO: 4212 - DNA, 4125 bp, Homo sapiens; identical to SEQ ID NO: 4210

SEQ ID NO: 4213 - DNA, 1481 bp, Homo sapiens; identical to SEQ ID NO: 3190

SEQ ID NO: 4214 - DNA, 1464 bp, Homo sapiens; identical to SEQ ID NO: 3184

SEQ ID NO: 4215 - DNA, 7066 bp, Homo sapiens
cgccaagcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggaatgtcgtccaggctggtctcaaactcctcctgacctcgtgatccgcccgcctcagcctcccaaagtgctgggatta

SEQ ID NO: 4216 - DNA, 6972 bp, Homo sapiens
cgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctccagtgttgagtttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacgcggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcctcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacggccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggaggacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctaggggcctggcttcctcagcctcttctctttaggcccagctgctgggcaaggaattccagtgcctcctacgggggcagcacacttagatattcctggacatccagattgctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttg

SEQ ID NO: 4217 - DNA, 7066 bp, Homo sapiens; identical to SEQ ID NO: 4215

SEQ ID NO: 4218 - DNA, 7151 bp, Homo sapiens
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagttgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcggagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgaaaaaaaaaaaaaaaaaaaaaaaaaaaaaaaaaaaaaaaaaaaa

SEQ ID NO: 4219 - DNA, 7066 bp, Homo sapiens; identical to SEQ ID NO: 4215

SEQ ID NO: 4220 - DNA, 1748 bp, Homo sapiens
gcagccctgcagaaatgcttcaattacccacagtattttttttttttttttttttttttgccaaataagactggtgtccagggtactgaagcctcatcttcctcaggctgatgccaaagatgtaaactttggtgcagatgcccaaaacttaatgcttcaaggtgtaggccttttagccaattctctagccattacaatagggccaaagggaagaacagttattattgaagagagctgaggaagttccaaagtaaaaaaagatggtgtgactgttgcaaagtcaattgacttaaaggataaatataaaaatattggagctaaacttgttcaaaatgttgctaataacacaaataaagaagctggggatggtatcaccactgctaccacactggcatgctctactgcaaagaaggccttgagaaggttagcaaaggtgctaatccagtggaaatcggaagtgtgtgaggttagatgttgatactgtaattgctgaacttaggaagcagtctaaacctgtgacaacccctgaagaaattgctcaggttgctacaatttctgcaaagggagacaaaaaaaaattggtagcatcatttctggtgcaatgaaaaaggttgggagaaaggttgtgctcacagtgaaagatggaaaaacattgaatgatgaattagaaattactgaaggcggccgggcgctacatttttccatgcttattaatacatcaaaaggtcataaatgtgaattccaggatgcctatgttctactgagtgaaaagaacatttctggtgtccagtccattgtacctgctcttgaaattgccagtgcttaccttaagcctttggtcacaattgctgaagatattgatgaagaaacgttaagtacgctcatcttgaataggctaaaagttggtcttcaggttgtagcagccaaagtttcaggttttggtgacaacggagccagcttaaagatatggctattgctactggtagtgcagtgtttggagaagaggggttaaccctaaatcttgaagatgctcagcctcatgactcaggaaaatttggagaggtcattgtggccaaagatgatgctatgctattaaaaggaaaagatgacaaagcttaaattgaaaaatgtattcaagaaatcattaagtagttagatatcataactagtggatatgaaaagaaaaaactgaatgaatatctggcaaaactttcagatggagtagccgtgttgatggttggtgagacaagtgatgttcaggtgaaagacaagaaagacagatttaccgatgtccttaatgctacaagagctgctattgaagatggcattgttctgcttcagtgcattccagccttggactcattaactccaactaatgacgatttttttaagtggtatagaaattattaaaagaacactcaaaattccttcaatgaccaatgctaagaatgcaagtgttgaaggatctttgatagctgaaaaaattatgcaagattcctctgaagttggttatgatgctatgattggagattctgtgaacatggtagaaaaaggaatcattgactcaacaaacattgtgagaactgctttactgcatgctgctgaggtggcctctctgttacctaccgcagaagttgtagtcatagaaattcctaaaaaagagaaccctggaatgagtgcaataggtggaatgggagatggtttgttctaattcctagaatagtgctttacctttgttattgaactgt

SEQ ID NO: 4221 - DNA, 4610 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgtttcttgtttcccttcagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaccccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactatca

SEQ ID NO: 4222 - DNA, 4613 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaccccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactatca

SEQ ID NO: 4223 - DNA, 5469 bp, Homo sapiens
cgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcgcaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgtgcccgaggccctgcaggccccagcccaggtgccgtccttgtttctcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacgcttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 4224 - DNA, 1806 bp, Homo sapiens
tgccttggagcctctaaggagatgaaactgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctcagcc

SEQ ID NO: 4225 - DNA, 1238 bp, Homo sapiens
ttggggtctgtgactgcggatataactgacgacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctcagcc

SEQ ID NO: 4226 - DNA, 1237 bp, Homo sapiens
gccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcaaaaaaaaaaaaaaaaaa

SEQ ID NO: 4227 - DNA, 1956 bp, Homo sapiens
gaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttg

SEQ ID NO: 4228 - DNA, 1608 bp, Homo sapiens
atggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcacattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacgcagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttag

SEQ ID NO: 4229 - DNA, 1608 bp, Homo sapiens; identical to SEQ ID NO: 4228

SEQ ID NO: 4230 - DNA, 1956 bp, Homo sapiens; identical to SEQ ID NO: 4227

SEQ ID NO: 4231 - DNA, 8976 bp, Homo sapiens
agcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 4232 - DNA, 8976 bp, Homo sapiens; identical to SEQ ID NO: 4231

SEQ ID NO: 4233 - DNA, 8976 bp, Homo sapiens; identical to SEQ ID NO: 4231

SEQ ID NO: 4234 - DNA, 1712 bp, Homo sapiens
tccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaaggtttcaccgagctgccctactccttgtaccccttctagctggccttagcatagctacgtcagcagctattggcacgactgccctgattcaaggagaaactggactaatatcactatctcaacaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcatctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaaagataaataataaaaaataat

SEQ ID NO: 4235 - DNA, 939 bp, Homo sapiens
gcatccatggccagccacctcatgctcaacaatggcaccaagatggccatcctgggactgggcatctgaatgtcccctccaggccaggtgaccaaggctgtgaaggtggcgattgatatcaggtaccgccacatccactgagcccaggtacgagaatgagaatgagataggggtggccattcaggagaagctcagggggcagatggtgaagcgtgaggagctcttcatcatcagcaaactctggtgcacataccatgggaagggcctggtgaaaggagcctgtcagaagatgctcagtgaccttaagcagggctacctggactactaccttgttcactggccagccagctttaagcgtgggaaggaatccttcccattggatgagtcaggcaacatggttcccagtgacactgacattgtggacacacgggtggccatgaagagctggtggatgaagggctggtgaaagctactggcatctccaccttcaaccatctccaggttgagaggatcttaaacaaacctgggttaaagtataagccagcagttaaccaaatggagtgccacctgtgcctcacacagaagttaatccagtactgccactctaaaggcattatggtgactgcctgtagtccccttggctctcctgacagcctctgggccaaggctgaggacccttccctcctggaggatcccaagatcaaggcaatcatagccaggtgatcatagccaggcgatccaggtttggatccggttccccaggcagaggaacttgatggtgatccccaggtctgtgataccagaatgcactgctgagtcacagactttgaaccaagcagccaggatattaccatcttattcagctacaacaagaactggagggtctgtgccttggtaagctgtgcctcttataaggattacctcttccatgcagagttt

SEQ ID NO: 4236 - DNA, 6480 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 4237 - DNA, 6794 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtagactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacatccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtg

SEQ ID NO: 4238 - DNA, 3180 bp, Homo sapiens
ccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcacc

SEQ ID NO: 4239 - DNA, 3728 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaa

SEQ ID NO: 4240 - DNA, 6492 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 4241 - DNA, 6058 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaa

SEQ ID NO: 4242 - DNA, 6480 bp, Homo sapiens; identical to SEQ ID NO: 4236

SEQ ID NO: 4243 - DNA, 6741 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgtaagtaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtagactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacatccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 4244 - DNA, 3234 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacacaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 4245 - DNA, 5051 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtaactggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttcccagagggctcaggatgccccaggaaggaaagaagggcaacagactacacgattggacgtgtgtggttgactgggatg

SEQ ID NO: 4246 - DNA, 3180 bp, Homo sapiens; identical to SEQ ID NO: 4238

SEQ ID NO: 4247 - DNA, 2606 bp, Homo sapiens
ccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggttaatacttttaagcagttttcagcacgtttatctcactttattctcgttctcctcggaccttcgtagccatatcacttgtataaaataggctgagatatagtgactgtaagctgtgatctcagtatacaaagaaccaacttcagcaagactcgggtggtgaatatcgagtctgcagagaccaaatagacttaaagcaatccatctgtcttttccaggttaggtagctagattatttatttcccaccttattcaaccatcatggagttcatgtaaagatgtgagggttaggcagacattttaataaagatttgcttcatttaggtgtgtcccataaatgcatttaattgtgttagatgttgtgtgctaaggctgtatttgatatatgtaga

SEQ ID NO: 4248 - DNA, 3677 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 4249 - DNA, 3242 bp, Homo sapiens
atgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagtgcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagtttttataagtgaagattttattttaaaaaccagtgggaaagagtggggggtttctttttatgtctgggtcattcaggcagtacatctgaattaagctgaatgtagacaaataaagaaaaacaaaactaaaaaaaaaaaaaaaaaaaaaa

SEQ ID NO: 4250 - DNA, 3180 bp, Homo sapiens; identical to SEQ ID NO: 4238

SEQ ID NO: 4251 - DNA, 2613 bp, Homo sapiens
gagcgggagcgaggggcgccggctggggtgtgtgctcctggtgagtgacaccgaggggaaggcgggcgggtcggcgggcgggggcagcctgcgaggggcgggagtgtccctgcgtggggcggccgagccggagttgtgtcagtgaaggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccaggtgaggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 4252 - DNA, 2613 bp, Homo sapiens; identical to SEQ ID NO: 4251

SEQ ID NO: 4253 - DNA, 1264 bp, Homo sapiens
gggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtc

SEQ ID NO: 4254 - DNA, 2154 bp, Homo sapiens
gggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttctgggggccctgcgtgggaagataaagttcctccctcaaggactccccatccagctgggag

SEQ ID NO: 4255 - DNA, 2137 bp, Homo sapiens
ccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctag

SEQ ID NO: 4256 - DNA, 2137 bp, Homo sapiens; identical to SEQ ID NO: 4255

SEQ ID NO: 4257 - DNA, 2136 bp, Homo sapiens
gccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcactttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 4258 - DNA, 3537 bp, Homo sapiens
ctgcctctccccacaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgtgtgggcctcttgtgttagtgttcaggctggggacatgggtgccacctccatcaggcctcccataaggatgcccaagtccctgcactcataagtgcctcccatctccctgagggctctgctttcgggggtgtcacctttcagaggaagccactcgatacaggggagagcttttactttccttagcatgtgaggagtgggagcagatattctctgaccccctgcacacccccacgtgcacaggcctggctgctgcctggtgaagcggggaccccagcgctccacccccttcctaccctcaggccctgcttctctcacctcgtggggaagcccaagcctcgtggcccaactggggctcagttaaactttgctttctgatttttctcttgtgccaggcgaccacctccatcggctcccgcacgacctttcttctgagcttcgtgggaggcccctcccacctgtctggctgccccctcgggggccggtctgtcctggctggtgtccctgagccccaatcagcaggctcttgtgattttctgaccataatttattgactccaatgcccaggccacaccaccctttgttataggaggcttctgcctagactttggccgggccatccctcatgcctgtgtggggcccctgcaggagaggggccggggcaggtggtcttccaggcccccttcctggcattctgttaccagacctcaacctggcttggagggcccaggtttccttgttaggccctgccccgcaccaggcaacgctaacacaggatgggaggcttaggctaaggcacatttacagtagaggggccaggaaatccgaggctcacgttccaacgctgcagtgcccaccatgtgagatttccaggaccgtcggtgcagccactgagccgtcccttctacaagccagaggtgttccctgcccgctgaggacggaaggagactcatggggcca

SEQ ID NO: 4259 - DNA, 4673 bp, Homo sapiens
tgcagcaggccagtcgcgtgcggcgcgagtgctttgggcgcagcccccggggccggggcgggaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgtgtgggcctcttgtgttagtgttcaggctggggacatgggtgccacctccatcaggcctcccataaggatgcccaagtccctgcactcataagtgcctcccatctccctgagggctctgctttcgggggtgtcacctttcagaggaagccactcgatacaggggagagcttttactttccttagcatgtgaggagtgggagcagatattctctgaccccctgcacacccccacgtgcacaggcctggctgctgcctggtgaagcggggaccccagcgctccacccccttcctaccctcaggccctgcttctctcacctcgtggggaagcccaagcctcgtggcccaactggggctcagttaaactttgctttctgatttttctcttgtgccaggcgaccacctccatcggctcccgcacgacctttcttctgagcttcgtgggaggcccctcccacctgtctggctgccccctcgggggccggtctgtcctggctggtgtccctgagccccaatcagcaggctcttgtgattttctgaccataatttattgactccaatgcccaggccacaccaccctttgttataggaggcttctgcctagactttggccgggccatccctcatgcctgtgtggggcccctgcaggagaggggccggggcaggtggtcttccaggcccccttcctggcattctgttaccagacctcaacctggcttggagggcccaggtttccttgttaggccctgccccgcaccaggcaacgctaacacaggatgggaggcttaggctaaggcacatttacagtagaggggccaggaaatccgaggctcacgttccaacgctgcagtgcccaccatgtgagatttccaggaccgtcggtgcagccactgagccgtcccttctacaagccagaggtgttccctgcccgctgaggacggaaggagactcatggggcca

SEQ ID NO: 4260 - DNA, 1828 bp, Homo sapiens
ctgcctctccccacaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccaggcgaccacctccatcggctcccgcacgacctttcttc

SEQ ID NO: 4261 - DNA, 3621 bp, Homo sapiens
gagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 4262 - DNA, 4673 bp, Homo sapiens; identical to SEQ ID NO: 4259

SEQ ID NO: 4263 - DNA, 1355 bp, Homo sapiens
tggttagcctgggaaaagagcccgcctcctggcccataaggccctgggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgctgtggtgcagtagccccatttggaggggagggtttggttgatgttggggtttgaatttagagccttgattaagcagggtgcagtgctcctgtgttccaggaggccccctgctattcagtgattctgttctgtactagaaattttatcagcattgatgtgtcatgaaggaatgacaggctttggtgtgatggttgagattaaatttagacttaactgttcaggctcaggtttcttttacaatgagagtataaggttcttgggaggcagtatgtgcagataagagggcagtctttccgtttccagccctttcctttaactgttacctcgggtgagttgttaatctgcctcagtttccttatctgtatcaggaggcagtaatagtagtatctctcagaggattaaatgatttaatacttaacaaaatgctcagactagcaccagccacgtagtgctcaaaaggggtttcatttttgtgtttgggtataagaaata

SEQ ID NO: 4264 - DNA, 616 bp, Homo sapiens
agtgaaactcttcctgttctccaccatggcgcaggatcaaggtgaaaaggagaaccccatgcgggagcttcgcatccgcaaactctgcctcaacatctgtgtgggggagagtggagacagactgacccgcgcggccaaggtgctggagcagctcacgggccagaccccagtgttctccaaagctaggtacacggttagatcctttggtatcaggagaaatgaaaagattgctgtccactgcacagtccgtggggccaaagcagaagaaatcctggagaaaggtctaaaggtgcgagagtatgagttaagaaaaaataacttctccgatactggaaactttggttttgggatccaggagcacatcgatctggggatcaaatatgacccaagcattggtatctacggcctggacttctatgtggtgctgggtaggccaggtttcagcatcgcagacaagaagcgcaggacaggctgcattggggccaaacacagaatcagcaaagaggaagccatgcgctggttccagcagaagtatgatgggatcatccttcctggcaaataaattcccgtttctatccaaaaggccaataaaaacttttcagtgaaatgtatgtta

SEQ ID NO: 4265 - DNA, 2067 bp, Homo sapiens
tggttagcctgggaaaagagcccgcctcctggcccataaggccctgggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagaattggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttatagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccg

SEQ ID NO: 4266 - DNA, 3140 bp, Homo sapiens
gggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctataatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccctagtatatggcatatgaataccaggatagctttataaagcagttagttagttactcactctagtgataaatcgggaaatttacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactcgactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaa

SEQ ID NO: 4267 - DNA, 3140 bp, Homo sapiens; identical to SEQ ID NO: 4266

SEQ ID NO: 4268 - DNA, 742 bp, Homo sapiens
gccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaaaaaaaaaaaaaaaaaaaaaaaaaaaaaa

SEQ ID NO: 4269 - DNA, 5995 bp, Homo sapiens
gttgggcagtcgctggcgctgccgctggtggtccctgtgcttgaagtgccggtggtatcggagtccatgcacccaaggcccagcacccagcaacattctctggcccagcagaggggataccccaaaccaagacagatgtctcacaaaacacaagcagagatgtcagtcttcaggcctcgcatggagaagatgaaagagaggggtggcttttccaaagcccagcgtcagcacgaagcttccacgagattattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctcaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcagatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgctggccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagagtttgctaaggcagtaatttagactttaccttatttgtgattactgtagtgattgattgattactattaactacaaggtataatttactatcaccttatttaaattttatgaattaatttgaatgttttttacactaactaacttttcccaataaagtccactatgaaaccacgacatccaagaggccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgtcattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctcctcctcctttcctggggctgagaggttgtgtctgtgcccactctcctgagctcagccagaatctcgcatgtaaagacatccaaatgccgacttcttctccccagagcctggcttttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggcctcagttccatgccacatggcccgttccacagagcagctcacagcttggtagtagctggcttccccagagcggtatctgcgagcagcgtccagatggaagccatggtgttcccttaaaacctgatacggagggtgattccccatcatgtctgtattctgtgggtcacacagaccaaggccggtccactgtggaaggcaaggacgaggttgccagtgcccggcggtgggcggccacagccagcctccctgccagtgtcccccacagccaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagcgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctctt

SEQ ID NO: 4270 - DNA, 5739 bp, Homo sapiens
ttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctcaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcagatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagagtttgctaaggcagtaatttagactttaccttatttgtgattactgtagtgattgattgattactattaactacaaggtataatttactatcaccttatttaaattttatgaattaatttgaatgttttttacactaactaacttttcccaataaagtccactatgaaaccacgacatccaagaggccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgtcattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctcctcctcctttcctggggctgagaggttgtgtctgtgcccactctcctgagctcagccagaatctcgcatgtaaagacatccaaatgccgacttcttctccccagagcctggcttttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggcctcagttccatgccacatggcccgttccacagagcagctcacagcttggtagtagctggcttccccagagcggtatctgcgagcagcgtccagatggaagccatggtgttcccttaaaacctgatacggagggtgattccccatcatgtctgtattctgtgggtcacacagaccaaggccggtccactgtggaaggcaaggacgaggttgccagtgcccggcggtgggcggccacagccagcctccctgccagtgtcccccacagccaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagcgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctctt

SEQ ID NO: 4271 - DNA, 5739 bp, Homo sapiens; identical to SEQ ID NO: 4270

SEQ ID NO: 4272 - DNA, 3429 bp, Homo sapiens
gagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttagaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccat

SEQ ID NO: 4273 - DNA, 1011 bp, Homo sapiens
ccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaggtagctgtgatacaaaccccaggacacccacccacccaaagagccaaagaatagttcctgtgacattccgccttccttccatgtagtccctcttggtaatctaccaccaagcttgt

SEQ ID NO: 4274 - DNA, 3077 bp, Homo sapiens
cccgccgcgagtctccccgccccgccttggtgcagccgcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaaggttaataataagcactttaataattgctagatttgtaaaaagaaacatttggaagacaacaccttaaaatcgaggaaactggattaacttttcctgggtgagttgaggtgctgctgtgcattttgcttttcttggttctgtggtcaccacttatacttgctattagtcacctatattaatctgatcaagtttacattgttttatctcctaactgtcaaaaactttgttgttgttgcctccattggcaataatctaagcaaaatgcctttccactgtcctaaagtcaatttttgttactgtacagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgccactgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttattt

SEQ ID NO: 4275 - DNA, 4671 bp, Homo sapiens
gccgcggcgggcggcgggcgcggcgcggcgcggcgccatcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 4276 - DNA, 4653 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgattttaaaaaaaaaaaaaaaaaaa

SEQ ID NO: 4277 - DNA, 2613 bp, Homo sapiens; identical to SEQ ID NO: 4251

SEQ ID NO: 4278 - DNA, 2336 bp, Homo sapiens
gcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 4279 - DNA, 454 bp, Homo sapiens
accaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagactcagtgacagccag

SEQ ID NO: 4280 - DNA, 951 bp, Homo sapiens
gaggctcctctcctagaccctgcatcctgaaagctgcgtacctgagagcctgcggtctggctgcagggacacacccaaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaagc

SEQ ID NO: 4281 - DNA, 782 bp, Homo sapiens
gaggctcctctcctagaccctgcatcctgaaagctgcgtacctgagagcctgcggtctggctgcagggacacacccaaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctct

SEQ ID NO: 4282 - DNA, 1693 bp, Homo sapiens
gaattcggggggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttcccccgaattc

SEQ ID NO: 4283 - DNA, 1792 bp, Homo sapiens
ctgcgcatgctttggcagacgtggcaccgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaaatgttctgaagacaaattttttatagccgcttatggccattttgtacaattttgaaata

SEQ ID NO: 4284 - DNA, 1792 bp, Homo sapiens; identical to SEQ ID NO: 4283

SEQ ID NO: 4285 - DNA, 1655 bp, Homo sapiens
ctgcgcatgctttggcagacgtggcaccgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaaggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaaatgttctgaagacaaattttttatagccgcttatggccattttgtacaattttgaaata

SEQ ID NO: 4286 - DNA, 1655 bp, Homo sapiens; identical to SEQ ID NO: 4285

SEQ ID NO: 4287 - DNA, 1856 bp, Homo sapiens
ctgcgcatgctttggcagacgtggcaccgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccatttatttg

SEQ ID NO: 4288 - DNA, 3112 bp, Homo sapiens
gggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgagttgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggattt

SEQ ID NO: 4289 - DNA, 2963 bp, Homo sapiens
ccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcaaaaaaaaaaaaaaaaaaaaaaaaaaaaaaaaaaaa

SEQ ID NO: 4290 - DNA, 3024 bp, Homo sapiens
gggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggattt

SEQ ID NO: 4291 - DNA, 7685 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcaccaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccgggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgttctctctcccaccctcccccaaatctgttttcatgtaaaagacaaataaatgatgacttcccccaaa

SEQ ID NO: 4292 - DNA, 7862 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcaccaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaag

SEQ ID NO: 4293 - DNA, 7670 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcaccaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccgggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgttctctctcccaccctcccccaaatctgttttcatgtaaaagacaaataaatgatgacttcccccaaa

SEQ ID NO: 4294 - DNA, 7745 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcaccaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgttctctctcccaccctcccccaaatctgttttcatgtaaaagacaaataaatgatgacttcccccaaa

SEQ ID NO: 4295 - DNA, 7862 bp, Homo sapiens; identical to SEQ ID NO: 4292

SEQ ID NO: 4296 - DNA, 7670 bp, Homo sapiens; identical to SEQ ID NO: 4293

SEQ ID NO: 4297 - DNA, 7745 bp, Homo sapiens; identical to SEQ ID NO: 4294

SEQ ID NO: 4298 - DNA, 7827 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcaccaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttct

SEQ ID NO: 4299 - DNA, 2361 bp, Homo sapiens
gaaagagtgagagccgcccacgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaagaaaaaaaaaaaaaaaaaaaaa

SEQ ID NO: 4300 - DNA, 2099 bp, Homo sapiens
acgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttgacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaattttttttttttttttatttttagtagagacggggtttaaccatgttagccaggatggtctcgatctcctgacctcgtgatccacccgcctcggcctcccaaa

SEQ ID NO: 4301 - DNA, 2326 bp, Homo sapiens
acgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttgacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaagagaa

SEQ ID NO: 4302 - DNA, 2099 bp, Homo sapiens; identical to SEQ ID NO: 4300

SEQ ID NO: 4303 - DNA, 2153 bp, Homo sapiens
acgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttgacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaattttttttttttttttatttttagtagagacggggtttaaccatgttagccaggatggtctcgatctcctgacctcgtgatccacccgcctcggcctcccaaa

SEQ ID NO: 4304 - DNA, 2122 bp, Homo sapiens
gcccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtcttcccatctgggtttttgggtttttctgtgttttcatctttttttttttttttcttgacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctttgtttgtaggaag

SEQ ID NO: 4305 - DNA, 1236 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggcatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataat

SEQ ID NO: 4306 - DNA, 1098 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggagccatcttcccagcccaccgtccccatcgtgggcatcattgctggcctggttctccttggagctgtgatcactggagctgtggtcgctgctgtgatgtggaggaggaacagctcagatagaaaaggagggagctactctcaggctgcaagcagtgacagtgcccagggctctgatgtgtctctcacagcttgtaaagtgtga

SEQ ID NO: 4307 - DNA, 1098 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggagccatcttcccagcccaccgtccacatcgtgggcatcattgctggcctggttctccttggagctgtgatcactggagctgtggtcgctgctgtgatgtggaggaggaacagctcagatagaaaaggagggagctactctcaggctgcaagcagtgacagtgcccagggctctgatgtgtctctcacagcttgtaaagtgtga

SEQ ID NO: 4308 - DNA, 1848 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagtcacacatttctggaaacttctctgaggtccaagacttggaggttcctctaggaccttaaggccctgactcctttctggtatctcacaggacattttcttcccacagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaatt

SEQ ID NO: 4309 - DNA, 3974 bp, Homo sapiens
ggccccgaagcggtgtatggattggggagtcccagccttgggattcccaattccgcagtttcttttctccctgtcccaacctatgtagggtccttctcctggatactcacgacgcggacccagttctcactcccattgggtgtcgggtttcgagagaagccaatcaatgtcgtcgcggtcgctgttctaaagtccgcacgcacccaccgggactcagattctccccagacgccgaggatggccgtcatggggccccgaaccctcgtcctgctactctcgggggccctggccctgacccagacctgggcaggtgagtgcggggtcgggagggaaatcggccctctgcggggagaagcaaggggcccgcctggcgggggcgcaagacccgggaagccgcgccgggaggagggtcgggcgggtctcagccactcctcgtccccaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggtgagtgaccccggcccggggcgcaggtcacgaccctcatcccccacggagggccggggcgcccacaggctccggggcctagatccaccccgaagccgcgggaccccgagacccttgccctgggagaggcccaggcgccttaacccggtttcattttcagtttaggccaaaaatccccccgggttggtcggggccgggcggggctcgggggactgggctgaccgcggggtcggggccaggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcgcgggtaccaggggccacggggcgcctacctgatcgcctgtaggtctcccgggctggccctcccacaaggaggggagacaattgggaccaacactagaatatcgccctccctctggtcttgagggagaggaatcctcctgggtttccagatcctgtaccagagagtgactctgaggttccgccctgctctctgacacaattaagggataaaatctctgacggaatgacggaaagacgatccctcgaatactgatgactggttccctttgacaccggcagcagccttgggaccgtgacttttcctctcaggccttgttctctgcttaaaacttaaatgtgtgtggggtctgagtccagaacttctgagtctccagcctccactcaggtcaggaccagaagtcgctgttccctcctcagggaatagaagattatcccagggcctgtgtccaagctggtgtctgggttctgtactctcttccccgtcccgggtgtcctgtccattctccagatggccacatgcatgctggtggagtgtcccatgacaggtgcaaaacccgtcagacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatggggtaaggagggagatgggggtgtcatgtctcttagggaaagcaggagcctctctggagacctttagcagggtcagggcccctcaccttcccctcttttcccagagccatcttcccagcccaccgtccccatcgtgggcatcattgctggcctggttctccttggagctgtgatcactggagctgtggtcgctgctgtgatgtggaggaggaacagctcaggtggagaaggggtgaagggtggggtctgagatttcttgtctcactgagggttccaagccccagctagaaatgtcccctgtctcattactgggaaggaccatccacaatcatgggccgacccagcctgggccctgtgtgccagcacttactcttttgtaaagcacctgtgacaatgaaggacagatttatcaccctgattatggcggtgatgggacctgatcccagcagtcacaagtcacaggggaaggtccctgacgacagatctctggagggcgattggtccagggcccacatctgctttcttcatgtttcctgatcctgccctgggtctgcagtcacacatttctggaaacttctctggggtccaagactaggaggttcctctaggaccttaaggccctggctcactttctggtatctcacaggacattttcttcccacagatagaaaaggagggagctactctcaggctgcaagtaagtatgaaggaggctgatgcctgaggtccttgggatattgtgtttgggagcccatgggggagctcaaccaccccacaattcctcctctagccacatcttctgtgggatctgaccaggttctgtttttgttctaccccaggcagtgacagtgcccagggctctgatgtgtctctcacagcttgtaaaggtgagagcttggagggcctgatgtgtgttgggtgttgggcggaaccgtggacacagctgtgctatggggtttctttgcattggatgtattgagcatgcgatgggctgtttaaagtgtgacccctcactgtgacagatatgaagttgttcatgaattttttttctatagtgtgagacagctgcctgtgtgggactgagaggcaagagttgtcctgcccttccctttgtgacttgaagaaccctgactttgtttctgcaaaggcacctgcatgtgtctgtgttcatgtaggcataatgtgaggaggtggggagaaccaccccacccccaatgtccaccatgaccctcttcccaacgctgaacctgtgctccctccccaatcatctttcctgttgcagagaggtggggctgagttgtctccatctctgtctgaacttcatggtgcactgagctgtaacttctccttccctattaaaattagaacctgagtataaatttctttctcaaattcttgccatgagaggttgatgagttaattaaaggagaagattcctaaaatttgagagacaaaataaatggaacacatgagaaccttccagagtccacgtgttgcttatgctgatttgttgcaggggaggagactagatggggctgtgccagttttctgttcggccaccatgggctttatgtggtcactgcttgggtgggtcatccttgctgctccactgcccgaggcccttcagtagaaccttgtcccaccaagacccgtgattacagggagttggatgtcacctagggtggtccctgcatacaaatctccttgtggtagcaagagacaaatttttagacctgtccaggtcttgccttcctcccagggctttttcctcattgtattttcgatttttcctacaatctttttaaaggaaccagattgtgacatttgcagagaggaggggtccatagtttctcatcatgattaactttctgttggactcctcttctgctctcctactctctcctgcttagtgtagt

SEQ ID NO: 4310 - DNA, 1098 bp, Homo sapiens
atggccgtcatgccgccccgaaccctcctcctgctactctcgggggccctggccctgacccagacctgggcaggctcccactccatgaggtatttcttcacatccgtgtcccggcccggccgcggggagccccgcttcatcgcagtgggctacgtggacgactcgcagttcgtgcagttcgacagcgacgccgcgagccagaggatggagccgcgggcgccgtggatagagcaggaggagccggagtattgggacgaggagacacggaatgtgaaggcccactcacagactaaccgagcgaacctggggaccctgcgcggctactacaaccagagcgaggacggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccgtcgggcggagcagctgagagcctacctggagggcgagtgcgtggacgggctccgcagatacctggagaacgggaaggagacgctgcagcgcacggacccccccaagacacatatgacccaccaccccatctctgaccatgaggccactctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtaccttctggaaaggagaagagatacacctgccatgtgcagcatgagggtctgcccgagcccctcaccctgagatgggagccatcttcccagcccaccatccccattgtgggcatcattgctggcctggttctccttggagctgtgatcgctggagctgtggtcgctgccgtgatgtggaggaagaagagctcagttagaaaaggagggagctactctcaggctgcaagcagtgacagtgcccagggctctgatgtgtctctcacagcttgtaaagtgtga

SEQ ID NO: 4311 - DNA, 2845 bp, Homo sapiens
tttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4312 - DNA, 1988 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 4313 - DNA, 2824 bp, Homo sapiens
cgccttcccgcccgcccctattgttccgcccccggcctcccgcccttccccttcccgcccgctccccttttcccctcagtcgcctcgcgcctgcagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4314 - DNA, 1472 bp, Homo sapiens
tcccgcccttccccttcccgcccgctccccttttcccctcagtcgactcgcgcctccagtttttggctttcactcttcaccagtgaccaaagacttgaccactcaaagtccagctccctgtaactgctagacatggacaccggtgtgattgaaggtggattaaatgtcactctcaccatcaggctacttatgcatggaaaggaagttggcagtatcatcggaaagaaaggagaatctgttaagaagatgcgcgaggagagtggtgcacgtatcaacatctcagaagggaattgtcctgagagaattatcactttggctggaccgactaatgccatcttcaaagcctttgctatgatcattgacaaactggaagaggacataagcagctctatgaccaatagtacagctgccagtagacccccggttaccttacggctggtggttcctgctagtcagtgtggctctcttattggaaaaggtggttgcaagatcaaggaaataagagagagtacaggggctcaggtccaggtggcaggggatatgctccccaactcaactgagcgggcaatcactattgctggcattccgcagtccatcattgagtgtgtcaaacagatctgcgtggtcatgttggagtcccccccgaagggcgtgaccatcccgtaccggcccaagccctccagttctccagtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacccatggcaacaccggattcagtggcattgaatccagctctccagaggtgaaaggctattgggcaggtttggatgcatctgctcaaactacttctcatgaactcaccattccaaatgatttgattggctgcataatcgggcgtcaaggcgccaaaatcaatgagatccgtcagatgtctggggcgcagatcaaaattgcaaacccagtggaaggatctactgatcggcaggttaccatcactggatctgctgccagcattagcctggctcagtatctaatcaatgtcaggctttcctcggagacaggtggcatggggagcagctagaacagagcagacccatccataatgcctgctgttcaccacccgatgatccatctgtgtagtttctgaacagtcagcgactccaggttttaaaatagtttgtaaattttcagtttctacacactttatcatccactcatgattttttaattaaagtgttttaattccttctctgttcagcagttacgctgagatatccatatttagttttataagcttctcccccttttgttttttggtttttgtttttgttt

SEQ ID NO: 4315 - DNA, 2977 bp, Homo sapiens
ccgaatgtgaccgcctcccgctccctcacccgccgcggggaggaggagcgggcgagaagctgccgccgaacgacaggacgttggggcggcctggctccctcaggtttaagaattgttaaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactagttgtgtggactggagtaacatcagacaactcttattgtttccaaattccactattggtgatagtggagtcccagcactaccttctttgagcatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccacgctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgttgataagggtaaatggcacggagatgttgcagtaaagatcctaaaggttgtcgacccaaccccagagcaattccaggccttcaggaatgaggtggctgttcgtcgcaaaacacggcaggtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtctcctagttgactttgcacctgtcttcaggctgccaggggaggaggagaagccagcaggcaccacttttctgctccctttctccagaggcagaacacatgttttcagagaagctctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcaggagcagtcttccatcatgctgaattttgtcttccaggagctgcccctatggggcgggccgcagggccagcctgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaattt

SEQ ID NO: 4316 - DNA, 2878 bp, Homo sapiens
cgccttcccgcccgcccctattgttccgcccccggcctcccgcccttccccttcccgcccgctccccttttcccctcagtcgcctcgcgcctgcagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4317 - DNA, 3104 bp, Homo sapiens
ccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4318 - DNA, 2319 bp, Homo sapiens
agagacaaggcctcgttctgtcacccaggctggagtgcagtgatgcaatcacagttcagagtagacttgaattcctgggctcaggactgtctacaagagagaagctccccacgtggttccgtagacagagccacactctgttggatgttgatcccagctcaccgcagccttgaactcctgggctcaagcgatccttccacctcagtctcccacgtagctgggactacaggtaaatacctaggagtgggcttttctagatcacatggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggtaagagccgatccgctcgcggcctccactgccaacctcagccttttactgcagcacccgccgctgcccgcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 4319 - DNA, 2785 bp, Homo sapiens
cgccttcccgcccgcccctattgttccgcccccggcctcccgcccttccccttcccgcccgctccccttttcccctcagtcgcctcgcgcctgcagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4320 - DNA, 1684 bp, Homo sapiens
cagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttgg

SEQ ID NO: 4321 - DNA, 1988 bp, Homo sapiens; identical to SEQ ID NO: 4312

SEQ ID NO: 4322 - DNA, 2857 bp, Homo sapiens
tttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggc

SEQ ID NO: 4323 - DNA, 1756 bp, Homo sapiens
gcggggttgaaagcgggcttcccgccccgcccagaccgccgaggctgccgccggagtcgccaccgccgcgccctcgcccacccgcccgcccgccgctcccggccccgctcgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtctt

SEQ ID NO: 4324 - DNA, 2250 bp, Homo sapiens
agagacaaggcctcgttctgtcacccaggctggagtgcagtgatgcaatcacagttcagagtagacttgaattcctgggctcaggactgtctacaagagagaagctccccacgtggttccgtagacagagccacactctgttggatgttgatcccagctcaccgcagccttgaactcctgggctcaagcgatccttccacctcagtctcccacgtagctgggactacaggtaaatacctaggagtgggcttttctagatcacatggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 4325 - DNA, 2175 bp, Homo sapiens
agagacaaggcctcgttctgtcacccaggctggagtgcagtgatgcaatcacagttcagagtagacttgaattcctgggctcaggactgtctacaagagagaagctccccacgtggttccgtagacagagccacactctgttggatgttgatcccagctcaccgcagccttgaactcctgggctcaagcgatccttccacctcagtctcccacgtagctgggactacaggtaaatacctaggagtgggcttttctagatcacatggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctggaggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 4326 - DNA, 4639 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtg

SEQ ID NO: 4327 - DNA, 4350 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtt

SEQ ID NO: 4328 - DNA, 4639 bp, Homo sapiens; identical to SEQ ID NO: 4326

SEQ ID NO: 4329 - DNA, 4280 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtt

SEQ ID NO: 4330 - DNA, 3151 bp, Homo sapiens
caggggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaag

SEQ ID NO: 4331 - DNA, 3154 bp, Homo sapiens
caggggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccaggtacagggagatgacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaag

SEQ ID NO: 4332 - DNA, 3176 bp, Homo sapiens
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaaaaaaaaaaaaaaaaaaaaa

SEQ ID NO: 4333 - DNA, 7937 bp, Homo sapiens
cgccacccccgggctcggggtggcccccgcttcagtcccagggcagtcccccagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcactggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaagg

SEQ ID NO: 4334 - DNA, 6695 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaa

SEQ ID NO: 4335 - DNA, 7817 bp, Homo sapiens
ctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcactggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcac

SEQ ID NO: 4336 - DNA, 7817 bp, Homo sapiens
ctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcac

SEQ ID NO: 4337 - DNA, 7746 bp, Homo sapiens
ctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagatgcacatcctcttcaaatctctcttgttctgctaccctcagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggtaagtaaagtgattgggcggcgggtggccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcactggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcac

SEQ ID NO: 4338 - DNA, 8055 bp, Homo sapiens
ctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcactggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacagtaagggagaagagggagaggagaggagggagacagaagaggaggatgaagaggaggaggaaacagagtctgttgctgtagaaatgcagcaacatgcttcccacgtgtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaagg

SEQ ID NO: 4339 - DNA, 7937 bp, Homo sapiens; identical to SEQ ID NO: 4333

SEQ ID NO: 4340 - DNA, 7867 bp, Homo sapiens
ctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcactggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcac

SEQ ID NO: 4341 - DNA, 1704 bp, Homo sapiens; identical to SEQ ID NO: 3931

SEQ ID NO: 4342 - DNA, 1021 bp, Homo sapiens
cctggcctcgcgggccgtgtctccggcatcatgtgtggtatatttgcttacttaaactaccatgttcctcgaacgagacgagaaattcctggagaccctaatcaaaggcctcagagactggagtacagaggtatttcttttaatccagatttatctcccaagctgtattctaggcctcctacaagtttcttcctagatagaccatgatattttaaactttgcatgttcaaaaattgaactgaggccgggcgtggtgactcacgcctgtaatcccagcactttgggaggctgaggtggatggatcacttgaggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacagctaggactcagattggatcaaaattcacacggtggggatcacagggagaaagaggcaaagacaagaaaggaagctgcaatctctctcgtgtggacagcacaacctgccttttcccggtggaagaaaaagcagtggagtat

SEQ ID NO: 4343 - DNA, 4734 bp, Homo sapiens
cctggcctcgcgggccgtgtctccggcatcatgtgtggtatatttgcttacttaaactaccatgttcctcgaacgagacgagaaattcctggagaccctaatcaaaggcctcagagactggagtacagagctcatgatggtttaggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacatgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgta

SEQ ID NO: 4344 - DNA, 2392 bp, Homo sapiens
gcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgggcgcgtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaacaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatgctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccacttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctctaatcaaggtcatgtagtaatgactttgttataaatgctacagctgtgagagcttgtttctgattgtttcattgttcgcttctgtaattctgaaaaactttaaactggtagaacttggaataaataatttgttttaattaaaaaaaaaaaaaaaaaa

SEQ ID NO: 4345 - DNA, 1241 bp, Homo sapiens
agacccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgtaagaagtaatgccctgggaccccccttactacagtggtgtgattcgtgcagaaaggta

SEQ ID NO: 4346 - DNA, 2431 bp, Homo sapiens
agacccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccatggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaattatt

SEQ ID NO: 4347 - DNA, 3137 bp, Homo sapiens
gttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtaatcgcagccactcgggaggctgaggcatgaggtttgcttgaacctgggagatggaggttgcagtgagccaagatggtgccattacactccagcctgggtgacagagcaagactccatctc

SEQ ID NO: 4348 - DNA, 3750 bp, Homo sapiens
tctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtaatcgcagccactcgggaggctgaggcatgaggtttgcttgaacctgggagatggaggttgcagtgagccaagatggtgccattacactccagcctgggtgacagagcaagactccatctc

SEQ ID NO: 4349 - DNA, 3750 bp, Homo sapiens; identical to SEQ ID NO: 4348

SEQ ID NO: 4350 - DNA, 2184 bp, Homo sapiens
cgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcatttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactact

SEQ ID NO: 4351 - DNA, 1244 bp, Homo sapiens
gccagtcggtgcccctcccgctccagccatgctctccgccctcgcccggcctgtcagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttaaaaaaaaaaaaaaaaaaaa

SEQ ID NO: 4352 - DNA, 1321 bp, Homo sapiens
ggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaaaaaaaaaaaaaaaaa

SEQ ID NO: 4353 - DNA, 2184 bp, Homo sapiens; identical to SEQ ID NO: 4350

SEQ ID NO: 4354 - DNA, 822 bp, Homo sapiens
acggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 4355 - DNA, 1520 bp, Homo sapiens
ttccccggggagggctccaaaatatagagagtttgcatcgtgaacccccacccctgtaaatcccaggactccagtccccgcaacactccatcttccagagatctccaggggtccagaaataacacctcacagccttccaagcttcccaaggatccggagactccttatctcgcagcgcaaacctcaggcaactacaggtcctccctgcacctttgaggtgcccctccccccactcaaggttccagaaaaatccatgccctcggaaaccccagaatcttactttcccgaggcaccccaggaccccagggtcatcagttcacagggctgttagtgctcccataaaactctagcctcccagagggaccccagcccccaccctcccgcccacgaacccctgcatttccagaatcagccccagggccccaacccccccaagcccccatttcacaacacgctggcgctacaggcgcgtgacttccccttgctttggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcagctg

SEQ ID NO: 4356 - DNA, 1520 bp, Homo sapiens; identical to SEQ ID NO: 4355

SEQ ID NO: 4357 - DNA, 845 bp, Homo sapiens
caggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggccaaaaagaaa

SEQ ID NO: 4358 - DNA, 922 bp, Homo sapiens
gaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgcctcccatctgccgcaccagcccgaacaccattgagggagctgggagaccctccccacagtgccacccatgcagc

SEQ ID NO: 4359 - DNA, 922 bp, Homo sapiens; identical to SEQ ID NO: 4358

SEQ ID NO: 4360 - DNA, 1188 bp, Homo sapiens
gaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcacc

SEQ ID NO: 4361 - DNA, 15325 bp, Homo sapiens
cattcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcagaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcagggccctgccagattctggggtgatttctatttccaaagtcaactgctttactattctcaatcgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgaaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaagattatcatcattgatcctcagcctttcctgctgtggaagcagagattaacacacttcaacatgcgctgcatgcaccatgctggcctcggtgaattcgctctttaacatctgtaaggccccggaggacttttttcctggaaaataatacacactgagtagtcactaagtgttgttaattaggatagattgatacaaactggacacttttcagccgttgaatcccccaccagcagctccagacctgtttgctctgctgcctgagggcctcgctccgtacccagcttctgccccgctgagattctgagtcgtgtgtggtcattagttatatatgatctgggtctcatctcctctgggactgtgaacaacttgggcacgtttctaacccacccaaaaccctgcacataatgtggatgaaccgatttgcaggattcggtataaatcctgaaaggcctcatccctgagcatcttgttcggttttccttttaggtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtgcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgggtggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccaca

SEQ ID NO: 4362 - DNA, 14897 bp, Homo sapiens
cattcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcagaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcagggccctgccagattctggggtgatttctatttccaaagtcaactgctttactattctcaatcgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgaaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtgcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccaca

SEQ ID NO: 4363 - DNA, 14714 bp, Homo sapiens
cattcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcagaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgaaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccaca

SEQ ID NO: 4364 - DNA, 14897 bp, Homo sapiens; identical to SEQ ID NO: 4362

SEQ ID NO: 4365 - DNA, 14884 bp, Homo sapiens
cattcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcagaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgaaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccaca

SEQ ID NO: 4366 - DNA, 14884 bp, Homo sapiens; identical to SEQ ID NO: 4365

SEQ ID NO: 4367 - DNA, 2684 bp, Homo sapiens
aggacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtcttagaggaaggactgggccaacaaagagcaccatgggagaatggcagtggtggcatttagtgaagacaatttagtatgaatgtctgcaaaagatttttttgatagcgttgagtgtctgaaagtcccattatttttcttttttctttttccccagtaacactttctagctccacggataaggaatcactgaacctagtagttcttagacagcttggtttgagaatccttttgcggttaaaaattagggactgagccaggcgcagtagcatgcgcctgtagtcctagccacattggaggctgaggtaggaggatcccttgagtccacaagtttgagttcagccagagaccctatctcactatatatatgtatctcaaagacttcaatgggtttttgcttacatgggccagtaattgttgaacaaccagctatttgagaaaaagccctgattttgctgcttttcatggtgtaaatacttaaccatggctgagtttgagctatctgcatgacacctctaaacacagagttgggaatagatgtgcacaatcagctctggggagctggtgcaatcctgccctagcacaccactggtttaagatagatatatcatatagatatttaccatttaccatattggaaagtaaaatggagaaaaatttaaaacacaagatacatgagcacacattccattagctattaaggtgatggacacggtgtccaaatgacacggtgtcatttaacttctggaaaacaacactgtgtactgagaacaagagaaagacaaatgacttttttaaattaagtttttaatttacaattgatgcataattttactttaaaaaaataagtgtgcaatttggtaaactttgacatatacagctataaaccactccaatcaagataacatatttaccacccccaacagtttccatgtgctgtattataatccctctggctagtcctttgtcaatcactgataaattttattactatagattagcttgcattttctaaaattatataaaaatgaaatcatgccattagtgctttttctgtatgtcttctttcactcaaaatcacttggaactcaaaattacttctttcactcaaaatcactcaaaattacatactctgtatgtcttctttcactcaaaattacttctttcatttttagacggaagcatttagacctcaaaattacttggagattcatctggtatgt

SEQ ID NO: 4368 - DNA, 1019 bp, Homo sapiens
gaggcgacgccgcggtccgcgctgatctccaggcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaaaaaaaaaaaaaaaaaaaaaaaaaaaaaaaaaaa

SEQ ID NO: 4369 - DNA, 2684 bp, Homo sapiens; identical to SEQ ID NO: 4367

SEQ ID NO: 4370 - DNA, 3728 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttg

SEQ ID NO: 4371 - DNA, 4149 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggggaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggacccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaacgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcac

SEQ ID NO: 4372 - DNA, 4248 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggggaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttctcatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggacccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaacgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcac

SEQ ID NO: 4373 - DNA, 4248 bp, Homo sapiens; identical to SEQ ID NO: 4372

SEQ ID NO: 4374 - DNA, 4149 bp, Homo sapiens; identical to SEQ ID NO: 4371

SEQ ID NO: 4375 - DNA, 4149 bp, Homo sapiens; identical to SEQ ID NO: 4371

SEQ ID NO: 4376 - DNA, 2230 bp, Homo sapiens
gcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcggcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactattaaaaaaaaaaa

SEQ ID NO: 4377 - DNA, 2335 bp, Homo sapiens
cggctctggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggagggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactat

SEQ ID NO: 4378 - DNA, 2335 bp, Homo sapiens; identical to SEQ ID NO: 4377

SEQ ID NO: 4379 - DNA, 2335 bp, Homo sapiens; identical to SEQ ID NO: 4377

SEQ ID NO: 4380 - DNA, 2029 bp, Homo sapiens
cgccaccgccactaccaccgtctgagtctgcagtcccgagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcatcccaagatgactggggtgggaggtcttgctagaatgggaagggtcatagaaagggccttgacatcagttcctttgtgt

SEQ ID NO: 4381 - DNA, 1529 bp, Homo sapiens
aatgcgcagcctgagagggggtgagctgacactgtcccagctgccacctagactcggagctccatccaaacctccagcgaagacatcccaggtcgggtgaatcttccagccctgggggtggaggtagtaaaggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 4382 - DNA, 2029 bp, Homo sapiens; identical to SEQ ID NO: 4380

SEQ ID NO: 4383 - DNA, 2199 bp, Homo sapiens
ggcgccgtgtgtcccccgccggtcggctggtatggctgcagaggagctcggggcagaccccgcactggccccagagccggcaaagtggagatctctaccgagggcagagacctacctccccgcagtgctacaagtggggcgccggaagagccccaggcgtgcagaagctcacaaaaggccacccgtcctcggtccattcatttttgttcactgttgattcagccccattcattgatgggctggggccgtgcgctgagcgcccacagtcgatggggaaaggggctctgaccgacagtccccacgccgggcgacaagtgctgtcccagcgttatcagtcgggcgccttgccagccgaaagggcctgtctaaattcgtttcctgtcccctaactcatcccggcgctggctggcctggagagggtaggatggggcggcgccgagaatggccgttatgaggaccctaagagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggtgaggcgttcgggtgtcccagtgttcctgcccgaatcccgtgcagctgcctaatatactgatttcagtgacctgctttgccatcgacttggatccttccaattcttagccccattaaaatccccatttaagctcttctgccctgtcacccctccatgaggctccttctgacctctagccgtgtctctgccctgtctctgccttgtctctgccctgtctctgctctgtctctgccctgtctctgccctgtctctgccctgtctctgctctgtctctgccctgtctctgccctgtctctgctctgtctctgccctgtctctgctccaaaccccaccagtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 4384 - DNA, 1452 bp, Homo sapiens
gacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaacca

SEQ ID NO: 4385 - DNA, 2029 bp, Homo sapiens; identical to SEQ ID NO: 4380

SEQ ID NO: 4386 - DNA, 1305 bp, Homo sapiens
atgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtag

SEQ ID NO: 4387 - DNA, 7194 bp, Homo sapiens
agatctctaccgagggcagagacctacctccccgcagtgctacaagtggggcgccggaagagccccaggcgtgcagaagctcacaaaaggccacccgtcctcggtccattcatttttgttcactgttgattcagccccattcattgatgggctggggccgtgcgctgagcgcccacagtcgatggggaaaggggctctgaccgacagtccccacgccgggcgacaagtgctgtcccagcgttatcagtcgggcgccttgccagccgaaagggcctgtctaaattcgtttcctgtcccctaactcatcccggcgctggctggcctggagagggtaggatggggcggcgccgagaatggccgttatgaggaccctaagaggtgagaccctctcgccttctggggtgggggggtcccgtcctttcccccactgaggacagaggcccgcccagcgatctgagcatgtgtggacgtcaatcttgcagcccctcttccaggccccctccccagccttgcagggctcaggttacccctggcctttcctaaaggtcactcattcctcttgacgtttgcaaaaggggaatgtaatcctggggtggggggagacccctcatctgtagcccctcccttgctcctcccaaagggtggaattagaacagggactgttattgggagacagaaagtgggggatagtagttgacctttggtaagggggcaggtgcccagggccagaggcttctgcttcaggctgtagtgggcacttggctgccagcccagtgtgaaggggggaggatggagagaaagagaggcggggctggctggggaccgagtggctcagggataaatgcgcagcctgagagggggtgagctgacactgtcccagctgccacctagactcggagctccatccaaacctccagcgaagacatcccaggtcgggtgaatcttccagccctgggggtggaggtagtaaagggtgagcatggtattggcttggaggaagtgggggacatttctgctttttttcctcctgggactggagatgcttgaaaaagctgggggaaggggcggctggagcaagcagatgggacaaactctgggaacaccgaaggatctagggaaaggaggctgtgaggagggcagcagggatggatagaaaagggcagctagagctggaacctgatagggaattgggggcccaaggagatttcggagcaggaaaatgagaaccagaaaggatttgaaggccaccagccatggagaacagactgcttgaccagaggggtggaaggagaaggcctaagtggaggcttgggggaggtgggggcttggtgagcggtggcatcccaggagctatagataagaggcccctggattcttaggatgggagggtggaataagagctgttctgagtgggggagggggctgcgcctgcctctttggtctgtgacctttttgtagggtatttttagctccagcacctgccttcttggagtggggaagaatcttaaagggcaagggatttctggttccttaagagatcaactgtctacactcactcacacctcctgtcctgcagccatggccatgcagaaaatctttgcccgggaaatcttggactccaggggcaaccccacggtggaggtggacctgcacacggccaagggtaacacaaggcccattggataggctcgctccgaagaccccaaccctttggcctttgcccccagttctgtgccatatcctctcctttctctcgggttccctttcccagacttcttcccaagcccccttcttccaacgtggaaccagagctggaagctaggagaagcaggagtctctctctgcactgcctcctgtccctgagctcagagaggacacctcagccctttgagaggtagagagactccctgtgaggtccttttttttgttttgttttgttttgagatggagtctcgctctgtggcccgggctggagtgcagtggtgcaatctcagctcactgcaacctctgcctcccgggtttaagtgattcttgtgcctcagcctcccaagtagctgggattacaggcctgtgccatcacgcccagctaattttttttttttttttgagatggagtttcactctgtcgcccaggctggagtgcagtggcgcgatctaggctcactgcaagctccgcctcccgggttcacgccattctcctgcctcagcctcccgagtagctgggactacagctaattttttgtatttttagtagagatggggtttcacggtgtcagccaggattgtctcgatctcctgatctcgtgatccgcccgccttggcctcccaaagtgctgggattacaggcgtgagccaccgcgcccggcctcagctaatttttgtatttttagcagagacggtttcgccatgttagccaggctggtcttgaactcctgatctcaagtgatccacctgcctaggcctctcaaagtgctgggattacaggcatgggccaccgcgcccagccatccctgtgatcttccaattcctcctgtcccaggccgattccgagcagctgtgcccagtggggcttccacgggtatctatgaggctctggaactaagagacggagacaaaggccgctacctggggaaaggtgaggagacaccagcgcagaaggagcctgtgtgggcggctttaggacatgggtgcacaatgggtagaggactggaacccccaaggctcttgaggagctggggtccacagaaaggggcccagttgattgagctccaaaactcatcctctggcctgtctaggagtcctgaaggctgtggagaacatcaacaatactctgggccctgctctgctgcaaaaggcaagtggggaagcccgctcgctgcagcctcctccccatgcccctgctccctcagcccagacaggcctctcccgaaacattttcccttatccttcccctgcatgtgccctgacttctgagaaatctgacctctgctctcccttctcaaactcaccttccagaaactaagcgttgtggatcaagaaaaagttgacaaatttatgattgagctagatgggaccgagaataagtgtgagtgaagggctagcggtggggaagggatgaggtgtgggagagatggcgagaggccatggggtgaggcctgatgggttatttctgggtcccccattttgggtcacaccgcagctggatggatttgtgttcattccacaggcatttcctatgcctgccttctgccaggcctgggccgggctgtggacacagacatgcagcggacacattcccccgggtgggggttcccagggctactcaggctgttggggagagatctgttaaccaattcttcatgctcagtggtttggagctctggcgtcttcctggagtagccaccccaaaccctgcagaagctctcatcctttcttcccgcttgcctccttccagccaagtttggggccaatgccatcctgggcgtgtccttggccgtgtgtaaggcgggagcagctgagaagggggtccccctgtaccgccacatcgcagatctcgctgggaaccctgacctcatactcccagtgccagtgagtgcagctacccgcccttcccagatctcgcctggacagagccaaccccgcccagccaggttggcccccctggaaaatccacctttcagaccagctcctaagaagcagtttcctgaaattgaatctctcctgctgtggtcccacccctccctctcttccacaatccaaaccttccctgaaggctctatgtgcttccttccctgccatataacccagttccttcccattccaatcctaggctcgataactccagcctcgttccacaccccccaccaccctacacccaaatcatattgagagtttctttgaggcaaagatcttggcatttctttgtatcttcttgagtccttcttaaaccagtgccttcttgatgaatggaaactctttgaatttaatctcaataataatgttaccatttcttgttacttactaggaggattgcataagagcatggtctctagagatagattgctgggtttgaatcctggctctgcctgttattagttgtatgattttaggcaagttctttaactgctctgtctcagtttccccatctgtaaaatggggggtaataacgataccaatgaatagaggtgttttgagaatgaaatgggctaatacatgtaaagtacttagtgcgtggcatgtagtaagtgctatataaaagtgttagctattatatactaggcacatgctaagaactttacattcaatttctctaattttcagcaaaagatcctacagggaagtaggtgctatccccattttacagaaatgaggaaagagaggctgggcacagtcgtcacgcctgtaatcccagcacttcgggaggccgaggcgggcagatcacaaggtcaggagttcgagaccagcctgaccaacatggtgaaaccccgtctctactaaaaatacaaaaattagccaggcatggtggcacccacctatagtcccagctactagggaggctaaggcaggagaatcacttgaacccgggaggcggaggttgcgccattgcactccagcctggtgacaaagtgagactccgtctcaaaaaaaaaaaaaaaaaaagaaagaaatgaggaaagaggctcttgagcaaaactactcatcctagaccactgagctagtaagtagggaagccaggtttccaccccaacaccccccgcccctgtcccttcttgagctctcatgccccggcccaggtccagacaccctctccccatctcaggccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgagggtcagtgctgagcaccctggggggcagaccccctggatctccacatgggcaggggaggctgcagacaaggggacactggagtctcaggtcctttcttggtcctcccccagccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggtgaggcgttcgggtgtcccagtgttcctgcccgaatcccgtgcagctgcctaatatactgatttcagtgacctgctttgccatcgacttggatccttccaattcttagccccattaaaatccccatttaagctcttctgccctgtcacccctccatgaggctccttctgacctctagccgtgtctctgccctgtctctgccttgtctctgccctgtctctgctctgtctctgccctgtctctgccctgtctctgccctgtctctgctctgtctctgccctgtctctgccctgtctctgctctgtctctgccctgtctctgctccaaaccccaccagtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgagtgcctcctgaccctgaggctcaccatagcctgcctctgccccagctctgcccactccagctacagtcttacccaccaactccaagcttacctttcccctggcacctgacttacccacaccttgatctcaagactttgtttgactaatccttggcctgactccaagagctttgcccctgtggctctgtcatgaccccccacccccagcccacaccattcctctctcagattccgctgttctcagcagcatctcaagagcccgaaatcaagataagtcttttcctctcctacttcccaaagaacttagtcactgccctccctgcagagtgcttgctacccaaaacagaagggagaggcccacccaacccctgctttcccactgaggaggttctagaaggccacatcaaatgtcctctccactcaggtgcaaactggctcagtctaatggctggggggtgatggtgagccaccgctctggggagactgaggacacattcattgctgaccttgtggtggggctctgcacaggacaggtacttgtagcttctctctactgagtgtctcaccaagttttcttggggtccctggcctcctgcctttgaggttaatgctcccttggggccaggtccaacccctcctttccagcctcacctaaccctccaaattcttcttccctcatcagatcaagactggcgccccctgccgctcggagcgtctggccaaatacaaccaactcatgaggtacagcgggaacagtgggcctgggcattggggtgctggaggctgttaggttggaagttcagcagccctaaccttgcctgcattctaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagctgtgtgcttctttgtgggagctaggggatgctggtttctgggctgagctggggaaaacaggaggtggcgagatgggggcggggaggggaggcaaatagatatgtaacctgctaggacaaagaggaggtgagggactcacagaggaagctgggtggttctagaacaacagaggtgttcacatttccaaaggaggtaggggaagcagatgctatatggtaaaatgaagctgcagagttgccaatggagccgggcatggtggcgctcgccttgtagtcccagataccttgggaggctgagtttgagaggatcgcttt

SEQ ID NO: 4388 - DNA, 1540 bp, Homo sapiens
aggtcacagagcgcggacacccgcggggcttaacaggcggggctatttttcgaggcggaagaatactcaagttgcaagagtggcaactttttcaagaaggggaaagtcccacttcgggccctttgggtttcttcgcagtcagatccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 4389 - DNA, 1529 bp, Homo sapiens; identical to SEQ ID NO: 4381

SEQ ID NO: 4390 - DNA, 2243 bp, Homo sapiens
aggaaaatcagatgttttagttctcttacagaccagcagtaatgttgaaaaatataaaagtagccgtaacagaaaacgaagtgatcatctcagccctcccttggagtggggggatatattgcggagctgagttttaatggctatcagttcttgatcagaaaagtgaaatcactccaactccttccgtattccacggaatatgacccgtcttgaactttgagaaattccccgggtctgtgtgaaattccagttccaaataattcacatgaatggttcacaagaatccaggtaggtttgatctaagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagcccggcccaagtcattgtttttctcgcctcactttccaccaagtgtctagagtcatgtgagcctcgtgtcatctccggggtggcc

SEQ ID NO: 4391 - DNA, 1529 bp, Homo sapiens; identical to SEQ ID NO: 4381

SEQ ID NO: 4392 - DNA, 2036 bp, Homo sapiens
agtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaata

SEQ ID NO: 4393 - DNA, 1529 bp, Homo sapiens; identical to SEQ ID NO: 4381

SEQ ID NO: 4394 - DNA, 1305 bp, Homo sapiens
atgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctctgtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtag

SEQ ID NO: 4395 - DNA, 4630 bp, Homo sapiens
ggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctacttgtatatacattcttgagaacactgcaatgtgaaaatcacgtttgctatttataaacttgtccttagattaatgtgtctggacagattgtgggagtaagtgattcttctaagaattagatact

SEQ ID NO: 4396 - DNA, 4067 bp, Homo sapiens
ggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttc

SEQ ID NO: 4397 - DNA, 6641 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 4398 - DNA, 4576 bp, Homo sapiens
ggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctacttgtatatacattcttgagaacactgcaatgtgaaaatcacgtttgctatttataaacttgtccttagattaatgtgtctggacagattgtgggagtaagtgattcttctaagaattagatact

SEQ ID NO: 4399 - DNA, 4630 bp, Homo sapiens; identical to SEQ ID NO: 4395

SEQ ID NO: 4400 - DNA, 4576 bp, Homo sapiens; identical to SEQ ID NO: 4398

SEQ ID NO: 4401 - DNA, 2589 bp, Homo sapiens
ttggacacttctgtcattggacgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtagcaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccataccaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaa

SEQ ID NO: 4402 - DNA, 4494 bp, Homo sapiens
agcggcggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgc

SEQ ID NO: 4403 - DNA, 4418 bp, Homo sapiens
agcggcggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgc

SEQ ID NO: 4404 - DNA, 3355 bp, Homo sapiens
ctgagtccccggccagccgaatccaagccgtgtgtactgcgtgctcagcactgcccgacagtcctagctaaacttcgccaactccgctgcctttgccgccaccatgcccaaaaatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccacccccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcacagtgactca

SEQ ID NO: 4405 - DNA, 3879 bp, Homo sapiens
ggcacgaggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctccactgtcttcttcaggtcctgagattacacggtggagtgtatgcggtctaggaatgagacaggacctagatatcttctccagggatgtcaactgacctaaaatttgccctcccatcccgtttagagttatttaggctttgtaacgattgggggaataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctcaaagaggtgactgggccctgcctctgtttgacaaacctctaacccaggtcttgacaccagctgttctgtcccttggagctgtaaaccagagagctgctgggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtccctcaaggggccatcctgtcccaccatgcagtgccccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggtttttaaaaaattgtttttggaggggtttatgctcaatccatgttctatttcagtgccaataaaatttaggtgacttcaaaaaaaaaaaa

SEQ ID NO: 4406 - DNA, 2022 bp, Homo sapiens
aattcggcacgagacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagcaactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttt

SEQ ID NO: 4407 - DNA, 3951 bp, Homo sapiens
tttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcacagtgactca

SEQ ID NO: 4408 - DNA, 2771 bp, Homo sapiens
agcggcggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 4409 - DNA, 660 bp, Homo sapiens
ccacgcgtccgggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaa

SEQ ID NO: 4410 - DNA, 550 bp, Homo sapiens
gttccattagaagtattttattttaaagtacacttgaaattttaaatgtgtacaaattcagaggtttaaaaaacttcgaaagtcacagacacagaatttaggaagctgaaggctgagagtctcccttctcacttaatccatgctttattttgcattcctcacaggtaaggaggcagtgcgtgcaactttgggcaatgatccaaatctagaattagctgccaaataaccttggtagactagtccctgggtgacaagcatgcttacaagagaaaaaggcagagctctcttccagaaactttcttcctgacattctcgcataatctttgagatctctgctctgtggatgtgcagttttgattttggacaaaacaacaggctctgcttgcttggtggtggaaaatgggcatctttatcttggtttccacgagcagacgctgaagccatgatgactttgtgcttgctctccttccagttgtttatcctctgcttactccttgacccagtgtctgtgtggtctgggtcgcctccgaggccgagtccctcgttgcca

SEQ ID NO: 4411 - DNA, 1881 bp, Homo sapiens
acaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgtaagtcatagaaataaaaaagcaagccaagtgtggtggctcacatctgtaatcccagcactttgggaggctgaggtgggtagattgcttgagtccaggagttcgagaccagcctgggcagcatggtgaaaccttgtatctatttttttaaaaagtaataaataaataaaaactttgaaaaaaagacattactagcaactggagatacgaatgtccagcctaactaaactgcctgtattgacttttggaaaaatcagcccctattttctgccactctgcatttcttagttcactcaacactttctgatatacagcttagcagttgggacttcttcttagaccatccttaaagcatggactaagagggactggcaggatatataatgagattatcaatagcagagcctctgcatgatagatcatttatggatttttattttcttcttttgccctggccagtcttttcaaaatgttttctacgatggatataaaaaatgagtaatttttaagaatcaggggatttctaataatagagtaaccacaaacttggggtttcatcttccttcacctggtatcaatagatcttttatgtacaaaaaggacacattttagttgatagtctgaaaccacattcattcctagcaggaggaacagattcgagatctcttccataggagggtccctctcctttgtgacctctctcctataggcaagatggactgaagctctccactactccaaggccataaggaagattaggggcatttctacccagtgatttggaagctacctatagccacaacccagccaccttcccctgcccccgtggcctcaaccgtttgcttgacaggtgggccctctctggccatctgtctccaggacagcactgtggcttgctctgtcctggcccttccaccaccagtgcaaagttgagatggggaagtctccagttcccaatcctgttctttttaaatagagacttcattctcagagtcttcattcattgatttagcgtggtccttttaattttaaaattaccagcgttgatttttaaagctctagaaaataactaatggagaagattctcaactaatctctcccaacctgcttttacagttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaac

SEQ ID NO: 4412 - DNA, 983 bp, Homo sapiens
ccaatgagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagacagcttggggactgtggggggctgctggggacgctcacgtccatgtgcttcttttccagtgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 4413 - DNA, 1455 bp, Homo sapiens
ggcgtggggaaccctcaggctccagtgaccttggtggggggcgtctgggggctccccctccccacccccggccgggcacggacgcgggtgaccgtactgcgacgcgctccgcggccctccagaccgttgtaggcgcgcgggctggggtcggggaaggggaaggggttgttccacgcgcgcgggtcgtggtcggggaaggggccgtccaggccgttgcaggcgcgcgtgccggggccggggtcgggggtccaagcttgcagggggcggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 4414 - DNA, 1874 bp, Homo sapiens
ccgacatgttgagtcataagacgcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctga

SEQ ID NO: 4415 - DNA, 3111 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttata
